United States Patent 8,781,750 (CELL-TYPE-SPECIFIC PATTERNS OF GENE EXPRESSION) - sequence listing, part 37

SEQ ID NO: 37499 - DNA, 66476 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcaggtaggatggggtcggggcgtccccgcggtaggtgtccgcgcggccggggtgtcctcgtgagggtgtccgcgcggcggtggccagggtgtccccgtgggggtgcccacgcgggggtgtccacataccggcctcttggtctagtcttgctcaggagtccgggctgcttctagccacaagtagcccccttcccaggtggggaaactggggctgggtgccttgtctaaggtcctgctgtgctgactgcacctgtggtctcccagagctggtatcccagtaacaactacagttctgaagatgatgatatcccacctcccgaggtcaccaggcaccggccccactggccagacttcccaacttctccccagacccctagactctagaggttagaggctgcacagagcaatgggaggatacacactcgtcctcctggagcccctgaagaacagttaactaaatcaggacaataatcataactgagcactcgaagcagaggctgggtgtctggtcactcaggacagttcaagcctcatcctgtaggacagactcccctagatccgaccagagcgccaccatatctgttatgtgtggccagtttcattccatgcacgacaacatggtcccccaccatgcagggggcccctcgacccagccccctggatgcttgtgacagcgagcagctctccccacaggcagtgagtgtagaggggtgtaaggacggggtcagggctccttcccagggatggcggctatgggaggcatggtggctggccctctgcccgcggtggactcgggagggagggctgactgtgtgtgtgaatgggcagagttggtgctatggaggttttgggggtctccaggacggagggtggcccaacagagttctgggaggcagtcaccacctcgtggccttgctgagacctggaaccctcagccagggcactccatctttcaaagcttcttggctgcatgcgtcaggtgggcaagctcaggaaggttaaatgcacccgtgctggcggagtcccataaaaggggattcggcatcaaaaggaggaaaaaggttcaaagggcatttatcatggggttcagaatcacggatgtgaggggcggtagtggggacaacagacagaaaagcttccccttcccatactcacagtccagacacggcaatagccaaattccaaatttctaggtattctggactcagaatggggaatatcatacgagacttagggggataatgcccttatcttcctattttaagggaaagaacaaactgaaccttctatgcaaaataggatgatgatcctggtcctcccagtaagaaataaaataagtagtctccaggcattcctttccgccagaggagcaactgttttttaaatagccctttcgtgcccagtctgttactaaaccatatgagttgtttttttggggttttttttttttttttttttttgagacagtgtcttgctctgtcgcccaagctggagtacagtggtgcgatctcagctcactgcaagctccgcctcccgggttcacgccattctcctgcctcagcctcccgagtagctgggactacaggcatctgccaccacgcctggctaattttttttgtatttttagtagagacgggatttcactgtattagccaggatggtctcaatctcctgacctcatgatccacctgccttggcctcccaaagtgctgggattacaggcatgagccactgcgcccagccgagtcattttttaatactactgcatgtgagttaacacaatcattcccaaattgaagttttagatgggccctcaaaatttttaggatatggttttcctacaggtttatattgaaagtatggggtatctcctattactcctctttttatttgtcttaaaggagaaagggagaggccagagaccaaatgtccccatttccctatagctaatctctctggaagacaagcagcccagacttgagcttctagatggatacaaccaggtgcatgtccaaggcacagaggagggtatttataacccatagtaacattaaatgcagtgccttctcctggctgagcggtgcaacggtcatctgtagttccaggcatccacacactatcgttagtatagatttctgcaggagcatccatccaggtgagaggtcgaataagtggaggaaaaggcacataagcccaataagaataattttgtgtagcaggtaaatcagtttaaggggaaactggtgagacagaaagtgtaaggaagataattattaaataaaacctattgtaagtgagatccagtgctgaaggaggaagagaagaacagagggatgttattttcaggctaatagaaatggtgagatttttaggttcgtaaggagaaaaagataattaggagaagtgggattagttagaggggtttacattgccattagggaggattgaaccagacccattttgatttggcatgccagtttctgaggagtcggtacagatctcatcaggtatgagggcagtctctgacgcgaacgtctcttcctcgtggtttttattgtcagtattcacacgaagtttaagtctcctagtgggcacccagacgggattgacgatctcctggtaaaacacaagcataccctcttccccacgttataattgttccaggttcccaggtattggtttgggagtttttccatgacactggcttgccttcgtttagggagaattttttgcctgtataatggcatttagctgcagtcagagtattgtttttaggaacatttagaaagcttaaacaatgctaaatataattgggagtggggagtagttaaattatgcttttaaaccagccttgtcttcttttacagtaacttgaagaggtttagtaattttttcacgttttggaccgagaccgagtctggaaacaaaccccatgttttccattatatgttgactgggagcactgtaaaagttatgtggaatattaatttcagccccaatttgtgccagcaaatctctgccccgaagattaatggggatgggcatgatataaggctgaattgttcccttttgaccatcagggccagtgcaagccaagataaatgtgctctggtgaacttcttcagcttttctaacaccttctagtttcatgttagtgggatgtttaagccaggaggaaggccataaattagaggaaataatagaaacatcagccccagtatcaactaggccctcaaccttttttccttgaatgtgtatggtgcaggtaggccattgtttagaaattacattaatccaataagcggctttttcaccgctggagcccatcccagggccccatgtcttatctcctttgtttaaaacaatgttaggtagtaaaagtaattgagcaattgactcactggccggaatggaaacaggaactttggcagacaccataagtttacataagtttaatctcatcagaggaatcagaattaatgagactagtatgaactatgatacctttagtatcatgaggtggatgccctgcctaacaccaggcccaccgaaccttgaggtaaagggccagtgacccccatggggacaattaaaggcaaagaattaggtagtaaatttagaggaatggtactacagagatcgaccgccctgctgcctactgtggaggtagacaagcattgtactgagacagaagaagaggctgggacccatctggattggctgtaggtaaatttgtttgtgctgggggctgcgttgggactgcttgacgcaaaaacacaacattggtctgagtccgaggtgtcccatttgatattggggcctgggactggccttgcttcctgtttccctggttctgtggcaagggattttcatctatatcagactgagtggcaagtacttgcccaatgtttacccttacgacaacgcaggcaaacagtagcaggagcatttggccgtgtttgttgagccggcttggccgcttttaagtttttaacagtgtagtttttttgggtatgaccaagttggccacaattatagcaggctccaagaaaagaatcagtcgagccagtttggttgccgtgcttcatggccggtgcccacagaatagctctgtgggtctccgatccaacgccttcacaagctttaatatatgcaggcaacacctcatgatcaggtaaattttgacgtaggatggaatgcacggccattttacactcatggttcgcattttgaaaagctaacatatgaagaagaataccttgagtgtgctcatcagagacagatttttcaacagcatcttgtaatttagctaaaaaatcaagatataattcattgtgaccctgtttaacaatagtaaaagaaacagaagcttggcctggggtgcgtaatttatcccaagctctcatacacacctttgttacttgttccgtggtgagagcatcaaagcctaaatgagcagtagtatcagagtaattatcggagcctgtgagctgagcctgagtaattggaatgccatcagcccgatttagctgagcctgcaggcgggcctcctctgaccaccaggtatggaattgtaaatgctgagatggagttagaacagcttttgccaaaaggtcgcagtctataggaagcaaaatgacctcggtacaaagagtctgtaataccgttttaacatatggagaagtaggaacatactgagtacaagcatccttgaattcttttaaaaaggtaagattgagcggcgtatatcgacacacttgtaccccttgagcattaggaggttccagcatgaccgaataagcccacgcctctaatctacttgtttgttttggcgtaataagcattgcatgaaagtttcaagagcaggcacatgagatagagtcggcatagaagtgacaggaaaagtatgtatagataagagaaactgagattgacggggtcggactggtataagagtgtgagaaaggggcattgggggagcagaagaggcagaagcatactggtgattactggcccagtcctgcacaaccagagtggcaggggtgtccctgcatgaagaagggtacagagaagcaggttgagtggatggcaaagtgaccggttgagggaccaaaatgataggagggtgaggggctgtggtggatgggggagggcctgcagaattacaggtaaattgtagtttggatggctccggaggcaaagactgtaaaggtttggagagggaagagttagcatagatatggtcctgggctgtctgagttggggccgcaggagctacaagtgtcggctcttcgtgaaaagaaataagatcatcagggggtgatgttaagccaaagtcactggagttagatattgaatcctcagtatcgtcaggtgggggaggagtaggcaaagggaggggctgagcagataatgaaggccgagtgggagaggaaagctgaggaagaggtagagggtggccagattcagaaaactgtggtaactgcagggtgtcacgggattggtatgtcattaggatggcacgtaccaaggcccaatcaccccaaacagtgacaggaacataatttcctgttgggaccagttctcggaattttgcaccaacatgatcccatagttccacatctaacgttcccttttcaggaaaccaaggacagtgttcttccactgccctgaatagggtgaccatattttccatgggaacccgaactcccccattttaacaggaatttaatatagcagagataagcataatgtttagactctgcgtgacccatagttaccccggagaatacacagacaactcaccaatcgttggggagccaaacaagcatttctgtggactggaccgatgaacatttctccgcacctaccaaagggaatcgggttcccacatgcacttaggaaaaagaaaaccacgttgggcgccagatattgggggaacctgcccctaatatttcaacgtacgttctttctattttctgtaagtgtcagccggctgagaaatgaagagaaagagtacaaagaggaattttacagctgggctgctgggggtgacatcacgtatcggtaggaccatgatgcccacctgagccgcaaaaccagcaagtttttattaaggattttaaaaggggaggggttgtgccaatagggagtaggtcacaaagatcacatgcttcaaagggcaaaaggcagagcaaagatcacatgcttctgaggaaacaggacaagggcaaaatcagaactcctgataagggtctatgttcagctgtgcacatattgtcttgataaacatcttaaacaacggaaaacatggtttaagagcagagaaccagtctgaccacaaatttaccaggacggagttttttccccaccctaataagcctgagggtactgcaggagaccagggcgtatttcagtccttatctcaaccgcataagacagacactcccagagtggccgtttacagacctccccccaggaatgcattccttttccagggtcttaatagtaatattccttgctaggaaaagaatttagcgatatctctcctacttgcacgtccatttataagctctctgcaagaagaaaaatatggctctttttgcctgaccccacaggcagtcagaccttatggttgtcttcgttccctaaaaatcactgttattctgttctttttcaaggtgcgctgatttcatattgttcaaacacacgttttacaatcaatttctacagttaacacaattatcacagtggtcctgaggtgatgtatattatcagcttatgaagataacaggattaagagataaagacaggcataagaaattataaaagtattacttgggggcccaggcgcggtggctcatgcctgtaatcctagcactttgagaggccgaggcagccatatcacaaggtgaggagatcaagaccatcctggctaacatggtgaaaccctgtctctcctgaaagtacaaaaaattagccaggtgtggtggcgggtgcctgtagtcccagctactcaggaggctgagacaggagaatggtgtgaacccaggaggcggagcttgcagtgagctgagattgtgccactgcaccccagcctgggcgacagagagagaatctgcctcaaaaaaaaaaaaaagaaaaaagtataaaagtattacttgggaattgataaatgttcatattgaaatgaaatcttcactatttatgttcctctgccacggctccagccagtccctccattcggggttcctgacttcctgcaacacaggtgtgagccactgtacccagactaggggtgcagtttttttttttttttttttctgagacagagtctcactctgttaaccaggctggagtgcagtggtgctatcatagctcactgcagccttgaactcctgggttcaactcaccctccagcctcagcctccctagtagctgggactgtgggccctgcagtttctccttttagagtaggaagacctgaactgtcccaggcttggagtgggtgggcgatgcagcccctgaacaggagccagaatgacaacacctgctgccaggaaagagctctagatagagcagccatacaggagggcccctgaggtggcaccctgaggtggccagcctgcctgtgggtgcacattttgggggacccttccacttgccctcactggtgcagtgctgcattctcttgggccttgctatgagctctgggctcctgctctttgctggcctgtaccaggcagtgggttcaaagaggagcagaaaattaatggacaatatgtcagaaggcagaggcaagacagacacttgctggggccaagccctgcaggtggagagggtatgcctggctaaagtgggtgaaaggcaaggttatgaggttctccaggacactggagtgcacaggtggtgtgtccccaggtaacgcctgccacccagcccttcctcccacagaacagcatctgccctacccacctttgaggtactttggggtccttccttcccagcaggctacccaagcccttccaagtgcttaaaggcagatttcctatgcttgcaaacgactgccctatgccagtgtttatcagcccgagagggctcctgggtgtgcacagggggcgagcaagctgcccaagataagcacatccatacagacagctgctcaccctgcctgatagcagacagagggggcacagtgcgaggctgcagggcaggatgacctaacaagggccctgctatggcaacaagaaggacaggcacctgccatggaaggtagggacgttctgagcaaagcttccggctaccaggcagctggaggagagagatgcttctccatcagcaggttcatgctccccgggggacctggtggcattttctccctgaccagcagtccttggttctctagacttatattaaagccattagaataatttacaacaatttaggcctttccagagcccttgagttgaattaggaattgagtgtgctttggactggctgttggaaccgagttgtggctctgtcagttcccgcaggtgcgcacacatctcacgtgcactcagaggctggctgccaggtgaaagagtgggtgggtttggttgtggggcaggctcgctgcaggccatggcctgagtgcctggatgcagcttcccaagctttctcagctgtgagccagggctcctctaggctccagctcttgtatcctttaggagtgcatgttctagacctgtctgtggggcatctgcagggccagggtgtggagagacatgacactccaagtacactctctgcagccttgcctgcctaggaaggtggaggtggctgcaaagataagtgcagccttctcatggcagacgctaggctctgatggaggtgttgggcaggttgcccagccttgtatgacagaccctgctctgatcatggaacctcttggccttgtctgaagcagcgaccggctccagatgctctgggagggtggtgcttctcatctgggcaggctcgtgtctgcagaggggctgagggcactacttgttttataccctagagtcttgtcatcagtccccaccctgccctcaccccagcagactgatgacttgctattatttcttccttccttcagcagggagttggctggtgcctggtgctgggtgtcccggacctcaggcccagttcagtgtacttcccctctctacttcctccctccagtcccttctccatccctcccttttttggctgccccttgcctgccttcctcgccagtagcttgcagagtagacacgatgacaccttttgcaggctaaaaaggctgagagtggcactatgtgcagtgagccaccatggaggaccaaggtgaggcgacaccacaaccagcccaaaaggaattccagggatgaaacctgagcccaggcagctctccctgtgcccagggtggcttccctcctagctgactgcagctgggcacaccaagaccctggctgtgtgcactggccagctgtgagggacaggggctgcttgtgcttttattcttttttttttttttttttttgagacggagtctcactctgtctcccaggctggagtgcagtggcgtggtatccgctcactgcaagctccgcctcccgggttcacgccattctcctgcctcagcctcccgagtagctgggactacaggcgcccaccaccatgcccggctaatttttttgtatttttagtagagacggggtttcactgtgttagccaggatggtctcgatctcctaaccttgtgatccacccgccttggcctccaaaagtgctgggattacaggcgtgagctaccgcccctagcctgtgcttttattcttgctcacttgtgacggagggcagccttcacaactgaaaggcacgtggacttgagaatgttttagtccaccttggtggctcatgcttgtaattctagcaccttgggaggccaaggtggaaggattgcttgaggccaggtgtttgagaccagcctgggcaacatagccagaccccatctctacaaaacaaaaaaatttagctggacgtggtgatcggtgcttgtagtcccagctattctggaggctgaggctagaggatcacttgagcccaagaggtagaggctgcagtgagctgtgattgtgccactgtgcccctgtcgtgggggcccttccgggtctatgtcccagccctgtgctgaccgtgttccttctcacctttcatccctcccccaagcagggcagtggactacaatcttctgggtgacagagtgagatcctgtctcaaaaataaatagaataaaaaagaaaatatcttagttctgtgtctggctgagaacactgggtgaggtttgagttcagagtggttggtatggtgtgcgtgtgatttgcaaagatgatcacacacgcccacggccaacctcaccaccatatggcttggtctctggatttgcacagactatgtgtatcgagtcactctttctgctctgttgtgtggtgtcttgtcacccctgaccatcacagaatggagtgtccaatcctgataaaattgatcctgtaccacgtttaaccagacagacagtccgtcccacctctcatcccttctctcagcaggtcagcgggactatgatctcctggtggtcggcgggggatctggtggcctggcttgtgccaaggagggtatgtattctgtatacttcgtggcaaggcctcgaagcttttagggcccctagagagggtggtgctgtccagaaaacgtccatgagcaaaatgcgttgcctccctgctggggtcaccccagtggcctctgtgttgtggcttgttccctgccactctccagctgtctgctgtacccagcggccgccgtggcacttcatggctgaactgccttcctcagctccagccctccagctcttctgctttactcacagtgacagccccaatccgactagtctcagctcccaccactcacaccctccgtgggctccccactttccttcacgtgcttctggacagtcctctccttcaccttactgtggctgtcaccctgcctgcctgctctctgcccctgcccggctagctgcgaggctggagctgcaccctcctgcttgtccctgtccttgttcttagtgctggtgccttcccccagggtccatggtcagttctgctgggtgagtcttgtacttggcctggcacccattgagtaaagatgttgggcgaacgggctggacccagaggtgtccagagatgacactttgcagttctctgctaacccacgtgatgcacaggccaccagcactttgccagactctgtgccctgctgtaggagttcctggtctgctctggccatgtctacacaatgataagagggcagttgtggtgaatggggagggaaggggatgagagggaggtggggctgaaatgagagggagttaactgggcactttggccctgaagctgtgcttctctgatgtccagtattgggctctagaagcatacatggtgtaaaagaaatccactactcttgctctgtgggggccggggagtgtgtaggaacctgggaagtctcctggcctattggggatccgcagaggcacccaggatcagtgccacactgtactctcagaaccactcccagaaacgatggcgcaggcagccacgaggcctagtgctgttccttttagcagaccgggcacctgggctgtgcgttcactcccatgctgggagtgaccagctgcagagacctgagtcccctttaatccggaatgtggacagctcctgggtatgtctccgcctttcatgagagtggcatttccctgcagaggatgacgtggttttgtggcttttttgagatgaactgtacctatcaaaatgggcaacctgatcattcttatgtgtgcatgtgtccatgcagccagtaccgcagtcaagattggcgagtgtgtcctccaccccgttagtctgccagggctgccgtaataaacagactgccataacagactgggcggctgaaacaacacatgcttattgtctctcagttctggaggctagaaatcatccaggtgcgggcagggctgatttcttctgaggcctctccgttgggctgtagatggcagttgtcgtccctctgtgcatgtctatgtcctaatctctacctgtacctgtcctaatggatcaggtggatgccctcttattttgttggctttttattggagacagggtcttgttctgcctcccaggctggagtgcagtggcgtgatctcagctcactgcaacctcaaactcctgggttcaagccatcctcctgccttagcctcccaaaatgctattacaagtgtggccactgtacctgtatatggcctaatttttttttttttttttttgagatggagtctcgctctgttgcccaggctggagtgcagtggtgtgatctcagctcactgcaacctctgcctcccgggttcacgccattctcctgtctcagcctcccgagtagctgggactacaggcgcccaccaccacgcccggctaattttttttatttttagtagagacggggtttcactgtgttaaccaggatggtctcaatctcctgacctcatgatccacccacctcggcctcccaaagtgctgggattacaggcgtgagccaccgcgcccggcctatggcctcattttaacttaactacctcttttttttttttgcaagcgagtcttgctttgtcacccaggctggagtgcagtggtgagatcttggctcactgcaacctgtgccttctgggttcaagcgattctcctgccacagcctcctgagtagctaggattacaggcgcctgccaccacacctggctaatttttgtattttagtagagacggggtttcaccatgtttgtcaagctggtctcgaacttctggcctcaagggatccgcctgcctcggcctcccaaagttctgggattacaggcatgagtcaccgtgtccagccaacttaattacctttttgaagaccctatctctaaatacagtcacattctgaagtgctagggtttagggcttccacatagggattttgaggggatatggctcagcccataacaccccaacattttctgaaaccttggcagttccttccggcttcccccacttctgcatcctaggcaaccaggcatgtgctgtctgtcactatagtttgcattttctataattgcgtataaacggaatgctgctgtatgtcatcttcctcttctggcttctttcactcagggtaatgaccttgagactcatcttcgttggcgcgagtgtcgatggtttcttgcttttcattgctgagtagtgttctgtttatggctgtgccgtttcgtgtacgtgttcccctgtagctggacacttgaattgtttccaccttttggccattgtggacagtattgctgtgaacgtctgtctgtgtgtttgtgtggatatatgttttaaattattttgggtaagtgcctaaaaatggaccaactggatcgtgtggtatatctcttatttaggtattttttcatttcttttagcagcattttgtagtttcttttttactcaagttttttttttttattaaaaaaaagaaagatgagggtctctctgtgttgcccaggctggtctcaaaatcctgggctcaaatgatcctcccaccttggcctcccaaaacgttgggattacaggaatgagccacggtgcctggcctgtggttttcaatgtctacgtctttcacatattttatcagatacatccctaagtgtttcatatttttagaatagttttattgagatatacctcacattacgtatgcatttgtcccttggtacccgaggacgactgggttcaggaactcccgctgttagcagaatccatggacactgaaatttgtgcatactggagtcaggcagttggccctgaagcacccacagatacagagtcagccctctgtatatatagttttgcatcctatgaatactgtttttttctttttctttcttttctttctttctttcttttcttttttttttttttttttttgagacaaggtctcatgtgttgcccaggctgcagtaaatggtgcaatctcggctcactgcaacctccacctcccgggttcaagcgattttcccacctcagcctcccgagtggctgggaccacaggcgccaccatgcccagctactttttgtatttttttggtggagaaggtgggtttcgctatgttgcccaggctggtgttgaattcctgagctcaagtgatccgtctgcctcagcctcccaaagtgctggattacaggcatgagccaccatgtccagtggagtactgtatttccaatccgagtttggttacagatttggaacttgctgatatggagagataatatatatatttttttgagaccgagtttcgctcttgtcacccaggctggagtgcaatggcacaatctcagctcactgcactctccacctcctggattcaagcagttctcttgcctcagcctcccgagtagctgggattacaggtgcctgccaccacgcccagctaatttttgtatttttagtagagacggggtttcaccatgttggccaggctggtctcgaactcctgacctcaggtgatccgcccaccttggccttccaaagtgttgggattacaggtgggagccactgtgcccggtcaagggattatatttattgaaaaaaaatccatgtatgagtggacctgtgcagttcaaacctgtgttattcaagaacattttagtttctccccaaaataccctgtacccattggcagtcagtctcttcccccctctccccagcccctggcaaccactaatctacttcctatatccgtggatgtgtctgttctggacatttcagctgttttttggttggttggttgtttgttttcagacagggtctgactctgttgcccaggctggggtgcagtggcaccatctcggctcactgcaacctcggcctctcgggctcaagcaattctcccacctcagcctcccgagtagctgggattacaggtgtgcaccaccacatccagctaattttttgtatttttagtagagacggggtttcaccatactggccaggctggtcttgaactcttgacctctcaagtgttccacccaccttggcctcccaaagggttgggattaacaggtgtgagccgccgttgttttgttttttgagatggagtctcgctctgtcaccctgactggagtgcagtggtgtgatcttggctcactgcaacctgtgcctcctgggctcaaatgattctcctgcctcagcctcccaagtagctgggaccacaggcacacaccactatacccgactaatttttgtacttttagtagagatggggtttcaccatgttggccaggctggtcttgaactcttgacctcaggtgatccgcccacctcggcctcccagagtgccggtattacaggcatgagccaccgtgcctggcctcttcgcattttctttttctttttctttctttttttttttttttgagacggagtttcgctcttgttgcccaggctggagtaccatggcacaatctcggctcaccgcaacctccgcctcccaggttcaagcaattctcctgcctcagcctcctgagtagctgggattacaggcatgcaccaccacgcctggctaattttgtatttttagtagagaaagggtttctccatgttgaggctggtcttgaactcctgacctcaggtgatccacccgcctcggcctcccaaagtgctgggattacaggcgtgagccaccatgcccggccctgcactttcttgatggtatcctttgtgccacaaaagttttaaattttggtgaagtcctaatttatctatttttttcctttgttgcttatgattttggtatcatagctaagaaatccaagatcacaaagatttacacctgtgttttcttctaagcattttatagttcaagctcttacagttaggtctttgatttattttgagttgctttagggtttatggcatgtaccttaacttgccagtctacccttaaaaaagcatacatctattccacccctcctaaccttcattctatgttattatatcatgtgtttactgttacatgttataaatccatgatacatcattattatttttgtttaaaatatacttaaatcgtgtgagaaaatctcacatactcacccattgtatttctgtgctcttcattcctttgtgaggatccacatttccatctggtatttttcttctaccttaagggcatcctttagcatttcttgtaatatggctctgggggtaatgaattctctcagcttttgtatgtctgaaaacgtctttattttgccttcttttttgttgttgttgttttgttttgttttgttttttgagatggagtcttgctctgtcgcccaggctggagtgcagtggtgcgatctcagctcactgcaagctctgcctcccgggtttgcgccattctcctgcctcagcctcctgagtagctgggactacaggcgcatgccaccatgcccgtctaattttttgtgattttagtagaaacggggcttcgccgtgttagccaggatggtctcgatctcctgaccttgtgatccgccccccttggcctcccaaagtgctgggattacaggcgtgagccaccatgcctggccccccgctttttttttttttttcagtactttaaaaattttgcccctctgacttctggcttgcattgtttccagtgagaaatctgctactatttttatcttagtgtctctgtagtgtgtcttggttgcttttaggattttctcttttcattggccttgagtccctccttcttcccctcacatgtggggacttttaattccatgtatattaggctgcatgaagcttccccacaacctactgatgctcttttcattagaaacatttcttactctgcgtttcattttggatagtttctattcctatgttttcaaacccaccaataaaagattctgcaacatctgacctgccattaatcccgtccagtgtatttttcatctcctgtattgtagttttcatctctacaatccagcttgagcctttggttatatcttccatgttgctcctgcactgtttgaacatgcagaatggctagtggggcagtgagctgaggagaagggacagaggggaagctcagctgttgggtctacgggtatgatggagaccatgcagctgaaagtaaaccgtcaccccttctgcttcagtgtgaaaggccaggtgaagatgctgcagctgatgaggctgggccttagggtgcggggggtggtggaatctgcttgtgggcgggagatgtggctatgtggctataaaggatgaagatgaacgccctgtttgcttttcagcctcgcttggatcaaggttaaaaggccggttgtggccttcttggtggaagaaagagagagataaggcactgtcctccccttcggagggtctggggatacactaatccatcaaaaccactgagggctgggcgttggtgtgtgcctgtggtcccagcactttgggaggctgagctgggaggattgcttgagcccaggaggtcaaggcgtaagcaagctgtgatcgcaccgctgcacaccagtgcctgggcaacaaagtgagactctgtctctttaaaagaaaaaagaaaaaaaagcctttttttaaattaaaaaaaaaatcaagtctacctgaatggcctgcagttggacccacaaaccaggtacccaagttaccaggcaaggcagctgcagttgtaccagtcagaagtccacaagatttgaaaaaaaaaaaaaaaaaaaaaagcctcaggggtttcagtgaatgctgtgttaacttttttttttgagacatagtttcactcttgttgcccaggcttgagtgcagtggtgccatctcggctcactgcaacctctgcctcccgggttcaagcagttcttctgcctcagcctcccgagtagctgggattacaggcgcccaccaccacacctggctaattttgtatttttagtagagacgagctttcactactggtcgtgaaactacagttggtcaggctggtctcgaactcctgacctcaggtgatctgcccgcctcggcctcccaaaatgctgggattacaggcgtcagttaccacgcccagtctgcttgttaacttctataagtcagatgtttgatgtgaccgagttcaaggctgatacagcccagagccaggacaggtcgagagctgcccatttttagggcctcagacttcctactgggagcatcgcagccccttctgaacagaggtttggagaaggtgggtcatttggagagaagtgacctaaactatcctagttgaaggaatctatccttgaaagtcatcattgaaggaattcaaaaagagaaaacttaagggaaaggaaaaaaatagttttaaattttaaagagtgggcatgtgggagagggggtggagatagttaagagttataggaaaacatttccaattaatatgaggagaaattttatattgggagagttcccaaaattaaatggccacttgggaaggcaatacattcccagacaaaggcaccaggcataggtgaacacttggtgaggatgttatgaaggagactcaaacttcaggtaagcaggtagaacaaattgcatataatatccttcctggccgggcatggtggctcacgcctgtaatcccagcactttgggaggccgaggtgggcggatcatgagatcaggagtttaagaccagcctgaccaacatggtgaaaccccatctctactaaaaatacaaaaaaattggccgggcatggtggtgcgcacctgtaatcccagctattcaggaggcttaggcaggagaatcgcttgaacccaggaggtggaggttgcagtgagccaagatcacgccactgcactccagcctgggtgacagagctagactccatctcaaaaaaagagaaaaaaagatccttcccacaccaaaagtctgtagctgtgaaaagtagctaccatatagtgcaagttgagatgcataagaggtttataaaaccaccctggagtcgaaggagagagaacttttggtagggagtaagtaggtaaaaagggacccaaaggtctgggatcttgaacactgaaggaggaacagtgttctgtgagaaaggtttgtttttaacatgttaatttcttcaacaaaccatttgaatacttaatgtggtccaagctctgggccaggacccggaacaacaaagacaaaccaggaccaaagcccctgactgacggagttctgcagtttagttaccgagacagacacatgaacagatagttcatcatatgtgataaggtggagttagggcacacaagtgaggcatctaagcaaggaaataaaaataaaaaagtatggaatagttagaatacctgttttattgatcttttctgctaattctgacatctgtgtctgttccaagtcagtctccattgactgatttttttttgtcccctttataggtgtattttcctgcttctttgtgtgactggtaatttttggttgaatgccagacacttgaatttaccttgttgggttctgggcatttttgtatttctagaaatactattattgagctctgttctgggatgcagttattaagagtcagtttgatccttttgggtcttctgcaaaagatttgttaggtgggtatggagcagtgcccagtctagggctaatgattctcaactactggggcatgacccaacgccccaggaattatatgcttttcccagtccagattctgggaacaggcactgtcccctgccctgtgtgggctctgtcccctccagtccttccaggtggttctgtctggtctcaggtagtttcccaagacacatgcgccgatcagatctctcagattctctgggcagccccctcctcactgtcttctgtgcatgacctctggctgcctcagtctcccccagttctcagccctctcctgtgctggattctccccatcttccccagcctgcagtgctgggtcctggagactccccagggctcaccatgtttgtttcctctctctcaggtcctttgttacctgacatggagtacctgaaagcccgttgtttcatgcattttacctgggttttgggttgcttcagggggagggtaaatctgggccctgctgctccatcgtggtcagatgtgggagttacacactggcacactggctttttttttttttttttttgagacagggtcttgctctgtcacctaggctggagtgcagtggcacaatcttgactcactgcatcctccacctgctaagctcaagccatccccccaccttagcctcccgagcagctgggaccacaggcgcatgccaccacacccagctaatttttgtattttttgtagagacagggttttgctatattgcccaggctggtctcaaactcctgggctcaagcaatctgcctgctgcggcctcccaaagtgttgagattataggcgtgagccactgtgccttgtggacattagctttttttttttttttttgagacagagtctcgctctgtcacccagtctggagtacagtggcacaatctcggctcactgcaagctccgcttcctgggttcacaccgttctcccgcctcagcctcccgagtaactgggactataggcacctgccaccacgcccaactaattttgtttttgtattttttagtagagacagggtttcaccgtgttagccaggatgttctcgatctcctgccctcgtgatctgcccaccttggcctcccaaagtgctgggattacaggcatgagccgctgcacccagccaagcaaaatggattttaaaaatgaactcttacaaaactttgttctaatcttgctttctaatagccacgaatcaaacactttccttggcattttagggttcatgagatttgtgtgtgccttgggaggcagtcaagtccaaggcctgaagtttgctgatgcagtgcccaagcccgggcaaatggaagcttgaaattagccctagctaatgtttttttttttttttctttctttcttttttgagacagagtcttgctctgtcgcccaggctggagtacagtggtgtgatctctgctcactgcagcctctgcctcttgggctcaaacgattctcttgcctcagcctcccgggtagctggggctacaggcttgcaccaccacacctggccaattttttaatttttatttttagtggagacacgttttaccatgttggccaggctggtcttgaactcctgaccacaagtgatacaccttcctcagcctcccaaagtgctgggataacaggtgtgagccaccatgcccggtcctggctaatggtttctgagttggccccagaacctgtggccctgggtggccacactgctggctgggagggcaactgggtggctctgcagcgggaagtgtggtttggagtcaggtctcggctcctgctctggggctggtccaccctggggctgctgcgtcacttctcctgagctttggtgtcctggtcctgagagtgaggcagcgaatgcccacctagggggctctggctgggatgggaaggggcaagggagagcctctgagtcaggagccattcccggtgagtggctacctgggggatgccacccagggatgcttgggtgggcactgggcttatggtgaacgtgaacatgcaggggcaggtggggctgatgccagcactgtgaggggtggatggtacaaaggctgcgggccctgagaggtctgagggctcctgcctgtgggcagcgcagctgggtgggcagtgccagaaagagactggaagactcaatgcagagccagcaggcagcgcagctcagcaggccagagcgcagaggcagatcaggggtccctagcattgcgcagctcagccactgtgtgggcagccgcaggcccaggccctgcccacactcttctggacctcacaagccctgaggagtgcctgttcttgagtcctgagccagctccccatgctcacctgctgctctccttatccttccagccgcccagctgggaaggaaggtggccgtggtggactacgtggaaccttctccccaaggtaggcagcaccctatgggagccgggtgtcctggggaaggaggtgggaggtgggcccagttcctgtacagagggcagctgacaccaaagtccttcagccctgctgtccatggtttctggacagtgtcctgtttcactcatcattactttaaagttcttgaccattatcgaaaacaactctggccaggtgcagttgctcacgcctgtactcacagcactttgggaagccaaggcaggccttgatcacttgagcccaggagttcgaggctatagtgagctatgattgcactactgcactccagcctgggtaacaagagcaaaactccatctcaaataaataaattaataaatattaaaaagtaaaaacaactgtttttattttcgagtacagttatagagagcagattcgtgtggcatgtcagctggtctgtgttagagttacaaagcaactttaaggaattccaaacactctagaagaacagggaagcctccagcagtcacctgaacataaattcaaatgtgctcttcccacgtcccaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggtaaggatctggcgccgtggcattccagtgcttttcttctactcttgggtggaagaggaagaggaggcttatcctcgatgagccctcatggggagtgggccgtaggatgggtttctcagccaggggcgactctgcgctgtctgcctcagacatttgggaatgtctggagacagttttggttgtcactggggaagggtttgctcccctttgcggggagcccagggatgctacagccatgcacagcacagccccaccaagaacagtgcatctccaaggccaggagtgcgggtgggaggccgcttcagctgagctcttctgggaaggggaccacgtggcccagccacacccacattggctcagataggcctctgcctgcagtgggtagcctttggggcacagagcagctgcatctggagagccgtgggtcagagcccctgttttctgtgagtccaaaggtctgcagccctgagcctgggacaggcggttgcacgtagggatggatgtcacgttttgccacctttaaaagcactcttgttttttgatatttctatgaatgtaccatttgaatctaatagtccatcgtgaggccctgcagctaacacctgtgttgtggattttacattttgtttcgtatcttcacaggaggaagatggcagaagctgttcaaaatcacgtgaaatccttgaactggggccaccgtgtccagcttcaggacaggtactgaagctctctccgggaatgggccgccctctgggccttctcttgggcgttctgtgcctggacacacacttacttactgtgcagagcatgctctggcaggctctgggggttcatgtcctgctcatgggtggggatgaggacaaggagcagatgggagtgactgtaggggaaggggagactgccctttgctgctgagcagagcctggaggtgctgccaaggaatgagtgaggccacattggcagaatggccagagcccagggctgcacagggaggaggcgcttggggctggaaggcctcaggccagagagcgtggacatagctaggcctggggctaatatgtggtgagggtcatcccagtggcaagcccccaccccgtgaacccccttcttactgcacacctccagctccttgggtgtgggtgcaggagcttggtgctttccgctggagcaaatgtccctacttggtcaccgttcctgtcagcccctggggatctccagcacagaggcctatgctcccctggcctacaaccttctcctggggctcagctgccagcacagcagatgcctgaaactggtaccgcctctggcccagcctttctcccggggctgtggaggggacagtggtcccgcagaggtctggtggctctcctcatgcaccatttgcttggccccagggcgggtcttcctggggcttcacagcaggcagcagttttgtgctcactaaatccaggaaagtggagccaggaagccaactgcttgccctccacctggacctcacaagctctcccctatccagggagctaagccacattgtgctgtggcatttctgtgtttctctgtggggctctgtatcccctggtacagtttcctggggacagcaggctctgccctccctcctccctgccctgggcagctcctggacgggcaccaaacaggcccagcccactgcctgctccggagccacctgcagaaggaggctggggcgcacctgggctgtttctgctttttcactcttctgaaaagtgctgccatgagcattgcccggctgtgtcccgtggcagcttcctggctgtcgaggtgattgaagggctcttgctgtaggaacttcacgcagctcagacagcccatagaggcacaggcttgccagtggggagaaggcaggctcaagcaggaggcagagccttcccagaacccttgctgcagcacggtccttttgtcattagaaagtgttggtcgggtgcagtggctcatgcctgtaatcctagcactttgggaggctgaggtgggaggatcacttgagcccaggagttggagaccagcctgagcaacatagttttattgctacatccctacaaaaaataaaatgaactagccaggtatggttgcccatgcctatagttccagttacttgaaacaaggcttccgtgagctatgatcatgccactgcactccagcctgggtgacagagtgagaagatgtctttaaaaaaaaaaaaaagggtggggcgcggtggctcatgcctgtaatcctagcactttgggaggctgaggtgggtggatcacttgaggtcaggagttcaagaccagcctggccaacatggcgaaaccccgtctctactaaaaatacaaaaattagccaggcgtggtggcgcaagcctgtaatcccagcttctcaggaggctgaggcaagagctgaggcaagagaatggcttgaacctgggaggtggagattgcagtgagccaagatcgtgccactgaactccagcctgggcgacagagtgagactttgactcagaaaaaaaaaaaagaaaagaaagcgtgggtcatttgtttctgtgcactatgctcccagccactgttttgccagccttgtcatgcccgttctcttggtgttaccacacccctgaaatcagaaggtgacaccatctggtgggcaccacagctccctgctggaacatgtccgggtgatgaggactgtccccaagagaggtccagccacctcttgctgcacaccagggctgtacgtggcctcttaggaccgtgctgagctggcttccgtccctgctttgacacctgtggttaacatgtccctgggatccctgggggacaggcgaggtgcccccacatcccctccatgcttctcagcatggttgccgcttacctcttggtccatctgagccacagcaccaggccctgctgggggctggagctcccttttaccagtgttccctattgatccagttggtgaggtttaatttgcagaggaagtgtttgaaaatcttatctttatctttcagaaaagtcaagtactttaacatcaaagccagctttgttgacgagcacacggtttgcggcgttgccaaaggtgggaaagaggtgagcatctgacttactcgcgtggctccttgtggacccttctgcagaccttgggcaccaactgcagctgtgtttggcctgggtgctgttcttagtaacacgtgctgctggaatcaaaaaggtggcttcttttgaggctgggcacttgtctttaacgtgatcaaataatttgctgccctgctgctcggagtggcatggcaacagggttggtgaccacaccctttttgcaggattttttggggatttgagggtgccttgaagtgcttggagttagaacatctccctgtgctttctgcctgtccccctcctgccaggctgatggttgatgggattccagctccatagggcctctgaactgctggccaagggtccacgctacagggcaggggccgtgggaactgctggccaaggtctgtggtgctcaggccctccggtggggtgatcaccatgcacctgtctgacccacggctttctctttttctcctcagattctgctgtcagccgatcacatcatcattgctactggagggcggccgagataccccacgcacgtgagtgtccccagagcatagcgtccctgctgccgtggcccattcccggcctctttgagggatacgtttttacacacgtgcttcccacagcagcagcttgcacaccctttccccctatactcactatcatcactttctgctttccaattctcttgaatccacactgctgaaatgtggggtccccagtggcctccacgctgccagatcctcaggacagctctcgttctgctctccccctgccccgctggatctgtccccttccacaccaggatcctgcttcctaagtctccattgctgattcccccttttcccttcagcctcagaatgttggaacattcaggatataagcctcattcttcatcttcctccttcacgtcccccagtttaaaaaaagtttgaaataaaattcacacgctataaaatttagccttttttagggtacaattcagtggtttttagtacattcacagagctgtgcggccatcagtcaccaccatccattgccagaactccttccatcatccctgaactgaaactattcccattaaaccctactccccagcgcctcctcccccagcccctagaaaccaccacctactttctgtctctatgaatgtgacaacactaggcacctcgtgtaagtgaaatcgtacatgtaagtccttctcatgtaactggtacgtgtgtgtcccttagtgactcgtatgtgtgtgtcccttagtgactggcttacttcactgagcataacatcctccaggttcacctacattgtagtgtgtgtcagtatcattcctttttatggctagatactattccattgtatggatagaccacactttgtttatctacttgcttggataaacacatgtgttatttccactttttagctattatgaatagtgccgctgtgaacatctgcaaagaagttttttggtggacttcagttttcacttctcttgggttacacttaggagcagaactgctgggtcatgtggtaactttatgttgaatctttcaaggaacgtttcaaggaacctcagactgttttccacaatgactgtgttttacattccttccagtggggtgtaagggtcatggtttcttgtttcttcacgtatcttgtaatttttttattgaaagctgaacatttcaaataatttaatgcgataactttggaaaccagattctccctctgccccaggattctgttgttacagctgcttatttggtgacttttcggaactgactttgtagactcttattctttgatgtatgtggccactgaagtctttacttggttagcttagtggtcagctaagaactgcatggagatttccctaaactaagaactctcccggtctttgctgagggctctgtgtgcgtttggaggggatgccttccacactcaacaggcagcagacagctctgccctagccttcacttcctgcttctgcagagatcaaggtcagctggaggtgagggttcagggcctcgttggtccttcctgatgtgtgcacagtgctgtgcatgcgcctggcctaggttcccaggaatatgctggaacctttcaaagctccagcagacatctcatactttggcttttcctttgaagctttttgggcagtctgttgttggctctaactgttacctatcccctcaggcagctgtgagaagaaaacctcagacaaatgcccccagagaaaggcttttagccctggctgagctccggtgaagttggatgaagatgaccctatagttgctgactctgactcttctttgtgggggggctttgaaagaccccagctgagttctgctctctctgacacatcactgttcagggctgccgctgaggtgggagtgggaccagagtgagttaaaacaccctggagttcccattctcactcagcttcagctgtttttcctgactttaaatgttccctgtgttgctgcaagcctgtggttaatttccataattctgaatctcccagttcttgccagttttatcgctgtttttaacagagaggtgaataactcctggcccagtcttgtgggttgtgggggcagagttgaggaaggggccccggggtgaggggttggggggcagctgcagcagggaaagcaaatgggctgggggtgagcagagaggtttggctgagaccagtccccacgggtctcccagggaaccgtgtgccgcctgctccaagcctctaagtaggctgcagccaagctcttgaagaccacggctctctcggcctggaggccacaccacctctgacttagacccaggggcagtccggtggaggcagagcaaggggaggttctgccacttcttggatgtgaccccagcctccacttcgtcctgtgcttactgtggaaacagggaaaggagcggccccgaggagcacaagcacccccagtccttagaggccgtgggacttgtctggccgccaggcagccacagcagcctctagagggggcaggttgcttatgcacagaggtggggctcagggctgcgtgactttgtaggatgacactgtgcagttgttcaaggcagctgctgcagacagggtcccagtgatcccctctcctggcagctgggctcatggtggttctgcttaaagaaggccacagccagcttccagcagcccagcggtcattgggtttctctgaggccccaggcagagctgcacgtgcatccgcaccagggagcactgcacaggggccctggcctggcccggccctgctctgcacctcacgggcagctgctgacggctctttgggctcacaggggatccagcaggcgctcctggtccttaggaggcaggcagctcagggctgcttcgctctccctgccacgccctcccagggtgtctgccaaggcttgcttgcgttttagtccctttgattgccagacctttcggttttccttgagtaaacctgagaaattcctgactttatttttttttgccagttggaagcataaactgtttgagatccgcttcctccaccagcacatcttgttctcatggccgctaaggggacgttcaccctgggcctcccacctgcttggccgcccctcttcaggtgacctgtatgatttctgggctcagagcccacccgggccagccctcgagagtgtgaagtccgtcctggcttcagccaggtgccctcagagctgcccctcagtccctgcccacctcagcctgtggcacttaccccctgtgcctcctctcctctggctggccttgtaggccacccctgccgcgcagacacacctgagctctgctggccctgatttgctgacctgttctctccccacttcctctctctgagtttggatcccccagaacccaggtgttgctccctggggctgcatgcccctgtctgtttgatgtgtctgtccagaacccgggcagacttgaggggtcccagctgtctgcctgtatggcccctgcagttgctgtacccacctcaggccctgtatcctgctctgaaccagggtcaaggggagggtcctggggaacagaggggaaaggtaccctgcgagggcaccgggacctggagtgcagcagcttagatgcagacaggccacctgcagccccaaagaggccacagcctgcagacaaggactggcagcagggaagccctgtgcatgtgtgccctgggaaagctctgcttgattctgcaaagctggcatcctctttaaggaagccctaggacaggccaaatggagctcttgtccaaggggtcatttctgtcttgacagatcgaaggtgccttggaatatggaatcacaagtgatgacatcttctggctgaaggaatcccctggaaaaacgtaaggcctgcgcgtgcttggtggggtcctctttttgttcaccagagtgagcactggacccttagagcctgtgctggtgctgggctcctggggctttctttccggtttacccaaaagaaggaaaaaaggcctgttatttgtggccaggtgtggtggctcatgcttgttagcctagcactttgggagactgagcgggaggattgcttgaggccaggagttcgagatcagcatcagcctgggcaatatagtgagacctctactctacaaaaatctgttttggttttttttttggcttttttttttaggtgaattctcactctgtcccccaaactgaattgcaatggcccaatcttggctcactgcaatccctgcctcccaggttcaagtgattctcctgcttcagcctccaaagtagctgaaattacaggcgcccaccaccacatctggctaatttttgtatttttagtagaaatggggtttcaccatcttggtcaggctggtcttgaactcctgacctcaggtgatccgcccacctcgtcctcctaaagtgctgggattacaagcgtgagccaccacacccagcctacaaaaatctgaaaatattaaccgagcatagtactgtgcacctgtagtcccagctacttgggaggctttaggtgggaggattgcttgagcccaggaggttgaggctgcagtgagctgtgattgcaccactgcgctcagcctgggagagtgagaccttgtctcaaaactaaacaataaacctgtgacttgtgcccctctgcagggctgttgatttactctgtcctgtggctgccttggaggtaataacaataacaggactgccatataaatggagtcagctgtttgttatctaggtcagtggttgtcaaatggggttcccaggagccctggggttccagtgggtcccctcaaggacatcagggagaacattaaggaggggagagccagcaatccctatcccagccctcatctaacaccctcactgtcttctgatttgtacattgggtttccctgaaatctagcaaagactccaaaggcctcagaaacaacatcttgattgtggaagggaggctagcagcgtgcaagtggctctcactccccatgggagcaggtgcagagtcactaagtgcattccgatgcccacagagtgggccatcccgaggtcccaggtccaggcagctcctgcctgtggggtgtggagacttcatgttggcagggagcagagagaccaccagagggcggcagaggcttggtcaatagcagtctcgagccttccccaggagaaaatatcagtggaaaagggtcccacttctgtgtgtgcccgaatgtgcatggtgtgcgtgcagatgtgtgtggtgtgtgtgtgtgaatggtgtgtgtggtgtgtgtgtgagtggtgtgtgtgtgtggtgtgtgagtggtgtgtgtgtgtgaagggtgtgggtgtgtggtgtgtgtgtgtgtgagtggtgtgtgtgagtggtgtgtgtgtggtgtgtgtgtgaagggtgtgggtgtgtgtggtgtgtggtgtgtgtgtgagtggtgtgtgtgagtggtgtgtgtgtggtgtgtgtggtgtgtgtgtgtgaagggtgtgggtgtgtgtggtgtgtgtgtgagtggtgtgtgtgcgtggtgtgtgtggtgtgtgtgagcagtgtgtgtgagtagtgtgtgtgagtggtgtgtgtgtgaatggtgtgtgtatgtgagtggtgtgtgagtggtgtgtgtggtgtgtgtgtgtgagtggtgtgtgtggtgtgtgtgtgtggtgtgtgtatgtgagtagtgtgtgagtggttatgtgtgtgtgtggtgtgtgtgtgtgagtggtgtgtgtgtgtgtgagtggtgtgtcacatgctctgcttgtcattgtttcacacttcacggggcatctttgtgtggggtcaggactggattcccttgaatggatgtggtatagttcctttgacctttctcttgttaatgagcatctcagtagtttctcttcttcatcattatcaatgctgcagtgaaaaccttggaggtgcatctgtttaccatcagaagtgcttctgacacattttcccaattattcattgtgataaaacagacatagtataaaatttaccactttaaccttttttttttttttttttgaaacagagtctcactctgttgcccaggctggagtgcagtggtgcgatctcggctcactgcaacctctgcctcccgggttcaagcgattctcctgtctcagccctctgagtagccgggactacaggtgtctgccaccacaccccgctaattttttgtgtttttagtggagatggggtttcaccatgttggccaggctggtctcaaactcctgacctcaggtgatccacctgccttggccttccaaagtgctgggattacaggggtgagccaccacgcccagcccacgttaaccatttttaagtatacagttcaatggtattaaatgtattaataatgtcgtgaaaccatcaccactatccatgtctggaactcttttcatccatgttgtatctgcatttccttctttttaagactgagtaatattccattgtacaggcacaccacattttgtttatccattcatctgtcagtggacacccaagttgcctctgcttcttggctgttgtgagcagtgctgccgtgaacataggtgtgcaaatacctcttgaagacctttcagttcttttggatgcaaacccagaagtgggattgctggatcttatggtcttgaggaacctccatcctgttcccaacagcgcccacaccatcttacattctcaccagcagttcaggaggactctgggctccccacatcctcgccagtgcatgttgttttctgtttttctttctttaatttttattttttcctttaaactgttttcttgatgttttctgtttttttgacagtggccatcctagtggctgtgaggtggtcttatacgctttacaaggggagctgcccttccgtcttaacactttgtgctgacaggccaattccatgtgtactctgcctgcttccctgtccttggtaactcaggcatcagctttttgataagacacaaaacagaaaggagcctctcctcccatacccctggcctgggcagtggtcactgctacccatggcgcccacactctcctgagagcagtcactgctacccacggcgcccacactctcctgagagcggtcactgctacccacggtgcacccacactctcctgagagcagtcactgctacccacggcgcccacactctcctgagagcggtcactgctacccacggcgcccacactctcctgagaacggtcactgctccccacggcgcccacactctcctgagagctgtcactgctacccacggcgcccacactctcctgagagctgtcactgctacccatggtgtgcccacactctcctgagagcggtcactgctacccacggcgcccacactctcctgagagcggtcactgctacccatggcgcccacactctcctgagagcggtcactgctacccacggtgcccacactctcctgagagcggtcactgctacccacggcgcccacactctcctgagagcggtcgctgctacccatggtgcgcccacactctcctgagagcggtcactgctacccacggcgcccacactctcctgagagcggtcactgctactcatggtgcgcccacactctcctgagagcggtcactgctatccacggcgcccacactcctgagagcggtcactgctacccacggcgcccacactctcctgagagcggtcactgctacccacggcgcccacactctcctgagagcggtcactgctacccacggtgcacccacactctcctgagagcggtcactgctactcacagcgcccacactctcctgagagcggtcactgctacttacggtgcgcccacactctcctgagagcggtcactgctacccacggtgcccacactctcctgagagcggtcactgctacttacggtgcccacactctcctgagagcggtcactgctatccacggcgcccacaccctcctgagagcggtcactgctacccacggcgcccacactctcctgagagcggtcactgctactcacggcgcccacactctcctgagagcggtcactgctactcatggtgcgcccacactctcctgagagcggtcagtgctacccatggtgcccacactctcctgagagccgtcactgctacccatggcgcccacactctcctgagagccgtcactgctatccacggcgcccacactctcctgagagcggtcactgctacttacggtgcgcccacactctcctgagagcggtcactgctacccacggtgcccacactctcctgagagcggtcactgctacttacggtgcccacactctcctgagagccgtcactgctatccacggcgcccacaccctcctgagagcggtcactgctacccacggcgcccacactctcctgagagtggtcactgctacccacggcgcccacactctcctgagactgtgctgagcttgtgctggtttccatcgactgcctgctgccttccattggacccactgatcgtggtttgtctttggacttggtgatagtatttcatgcagaaattttaagtttttctgttgtcacaccaatcactttttcctgttatgccataatttctgggttatctgtttttttatctttgagacagggtcttgctctgtcgcccaggctggagtgcagtggtgcgatcatggctcgctgcagccttgatctcctggattcaagcaattctcctgcctcagcctcctgagtagctgggattacaggcgctcgccaccacgcccagctaatgattattttttttagggcaaggactcgctatgtggcccaggctagtcttgaactcctgggctcaagtgatcaccctggcccctcaaagtgctgggattacaggtgtgagctacggcacccagactgtttttttaatctttgactatctgctgagttacacatgatctgactctgtttgcatttgctgtgatcagtggtcttttcacacatttacctgaaaagcctcgtgtcacagcctcatttgagatgagcgtgtctgtgagcatgcccatgtgtgctgcacaaatcgccagcatggtccttgtccactttcacgtctggcttttctcttctcttatctcttcttaccctccagctggtttgtgtattagggatgtgatcctctgtcgcttgtggtgcagattttctcagcttctagtgtcttttaacttgtgtgatgtacaaatggtttaagttttttttaatgtaacttaaatcttttacacttagtggctttttgatttattgcatgttcagaaaggcctgccccacccccaagattttttttttttttttttaagccctgtattttccttatgggcgtccacaagtcggattttcttttacttccttgggctggctgcacttcttctgcggtgtggtggagatgggttgcccgggccccagtgcccatctcgaggcactgttctcactcggcgtcctgagttctgcctgtgcctctggttgtctttcacgtaggcttctctgggtggagtctggatgcccctccagcccctgcaggatgctttgtctgctggaccttcagggaaatggccttggatgtctggcagccccaggatgtctgctgggcccctcgatgtactggggtcttcggtgacggtcactgcagcccagcactttcaccaccctcgttgtgcctgttcccctcagaggctgcccgcttgggcctggggagggggcccggtgctctgggtgccctggccttgctgtctccctagcaaggtggctggggcttggggagcgctcctctgcaaccctgtgctgggggcagctggctcggccgggaagacacagctccagatattttgttcagaaaagaaactgcagtgtttattttcttcagaaaaaaaacatttagaagattttttttaaagctctttcgtttagaaggaatctaggtatgttattgtttaagaaaaaaagtgtttgcaatgtatcagtcacccgtttcattctgagcatgatttatgtgaggaaatggtttttttaaaaattaagctggagatatatccctgtacgatgcttctgtgaaaatgcggcttttgtccggcgctgttaatgcaagttgtaacagtgtaatatgggagtcagtgtttacatgttacattcctctgctgcagtcaaaataagcccggagggtctacagtagcatttctgtattttatcagcttgggctggggctgaggggaggcctccactcacacttggaggggctgtttctgccagatttatttgccttataaatattccccatgtttattttaactcgcctttaaaatggagctgaaattaatatggaccccggggctgctcccctggcccctgagtgcctcccgtagtcgggtgggacatttctacctggtcccatcctggaggccaggtgcgcaactcacggtgcctggcatcacagtgcccctcctgcagtgggcactctgtcccctggttggctcctccaccaaggaggctccctgtccccctggccccaggccctcggtgggctctgcggcgtgcacgaggcctccctcgtccctctctactacaggcacaggctgccaccaggaactcctttcagcgcacgtctgtgtggggcccactgccgggagctccagatctggcgagtggtgcccacagtggggcctgggacccagcctgcaaggtcgtaccatgccacttttgccccagagaggccactcaggcatcacagtgcacctcgggccccaagttgggagcccccttcctcctttgtttgcatccaggtcttagggagcccagggctggacagatggcagaggcagggggatcgtgtccaagctcagtcaaggggagacagaattaaacagtgcacttcactaaacagccatatgctggcaaaatggggccatacctgttgaccagagtgggctgagcacctggtttgtaacctaggagggtgaggaagacgtgcagaaaactcagaaaactcctgaaaaagcagtgtgagcttgtgggtgggtgagcaggacccttgagtgcactggggtggggcgggggacgttctggctgccccactcccatagccacgccctggcgcaagggactgtcctcccagtcttggtggggaccctgggaaggactccaggtcggctcctgctccgcctctgccatgcagatgcccgccttgtgccagcccgtttgccttttctgctgtgttgtgtctttccttctctggaactgcaagacaggttgaagaagagaggaggtttctggggaggtacagtgaccctgggcaggcagtggagcccctctgggaacaatggccactgcagggaggcaggggtgcggaggggcacgtgaccccaaatgactaggctcagagggggcatgcagccttgcaaaccaaaccttccattccacagagcaagcccccggcaggtggaggaatgtggaaggcgaggatggtgagcccacaccggggagctcctttacagaggcaggcactgggggtcgggatccaagtgcagccaagaggagcccgaggcccagaggggcctggcaattaaggggggccaaggagctgagctccaactccagtcccacagccgcacaatcttcctgccacttcctgacctggagggctgcctccaccgggaagcctccgcacccggcagggacttgggccccgccagtgtgccttgtctctgcctcttgcacacccacggccctgggcttcgtcttctccctcagtgccaggttttggagctcaggtgccctaaccccaatatagggaattgtggtccctctattctagtcctccctcttgctgtgtctgtaggtccgctttctgcaaagcagggctctgagctggcaacactgggatggggccgagggcgtgaatgagaccgcagcctcctctcaggtccgataacggaggtactgcttcccggaaacaaccagggtctgcctgttcctgctgccagctctgtagcccctgcccaggtccccgtgggggtttacagagcatggggccagcctctcctgcagctgccaggctggctcaggggctgaccagcccacacactgggccctgggggaggggctgcagccagccaggcctgtccaccctctgaggctgctccaccagcctgctgctgtctgtcctcgcactcctggggctccaagaggcagagtgtttttataacttgggctggtttaaggctgcctgtcagtgtgtcatggaaagagcttttatttgacccttaggaagtccggaagccagccaggtactgcgatcatttttctctcttcctaagcacaagagggaagaagataaattttatcttgggaagaaccacagccatttgggagaaaatttaatttaagtggcacattccgctggtgtgatgggatgtccttgtgttcagcaatagggagaccagctgtcctcctggggcttgttaccagactgcaaagcccccgccacctctctgtgtgcgtccctgtggctaagacatgacaaggtagggctttcagtggcatttgttacagggccagcacacagaggctccggcccagcatctgcccctgaggggttgggtggggcggcggggttccagccaagccggggaaggaggccttcgtagcacccccagccctgtgctgcctccctggggcatctgcagcttggcggcccatctggtatttcctgggctggcaggacctccaaggggccaggtgcctcccatgagactcactttgtgtgagtattccctctggagagcaggccttcaagctcaagaggcagatggattgctctttaagcctaggcttcgtgggcctgaattaatgcttttgtttctgcttcctccccccattccaattttgaacaagaaagcctgccctgtgattaggctcatcctgcagtagttattatgcctctttggaaaatgtttgcacaccaaaaagcacagagagctgagctgctgggatcacatggaaaactgatttttatttgttttgttttgtttgttttagagacagggtctcactctgtttcccgggctggagtgcagcttactgcagcctcaaactcctaggctcaagtgatcctccttcctcagcctcccgagtagccgggactacaggtgcataccaccatgccccagtaatttttttagtttgtagagatggggacaagctgtattgctcaggctggtcttgaactcccgggctcaagcagtctgtccaccttggcctcccagagtgctgggattgcacacatgacccaccgcacccaacctctgggtcttttaatgcagcggtaagttgagtggttccagccccctacccccaggtcctgtgagctggtcccctgacttctgtggccagcacctctgacttcctgtggccagtcatggcttgagttggttgctgcaccacgttcctgtctgtccctacccctgctgggccgtgaatggcctgaagaaggtgtctgtaggtccctgtctttgggtactctctatccctgtgatctggaggctttggtgtctgtcttattttgctcgggcatttttttactttagctggtctgaacggagttctctgttggaattctcgtatcctgcattcttcaaagggtaaacattcacataatttgatcaatgcggggaggcgtacagtgaaaaccaatgctgtcaataatccttgctcatgacaacaagaagaggcccaaaatgaccctccacacgagcgagacgtgagcttttgttgagagatttcagccgaacacatagggtcaaggatgcccactcgggaatatgcccactgcacccacctcctcctagctgtaccctcagttgctgattcagagctggcagctgagggatgggggcacctgtgactttgaaggtggcccttgaggcgggagcttctcctgtgccccgtgggtgccaggacaggaggcccgggcactgggggactccgagggagggcctggagagtcacctgcccccgctccaatccaggcctggtgggtcagcatcgtgtaggaggtggggatgtacacgtcggtggcagagacagcaaacatttgtggcaaaatcaggagggtgtgttgctgtatccctagcaatgagctaggaggcccggagagcagcctggcccccatcctgcagctgcagggcccattcctggagaagggttggccttcagggccaggaaggccctgacgtgcaggggcccagctgcccacagaggggatgcattggcctcactctgccagtgcctgcacagcccagcaggaagcatctagcccatgcacagccacctctgggagcagggggcaaagggcaccacacaatgggctctcgcccagttacacccttgcatttagggcaggatatgcaaagcagcagagttctgtttatatttgcagtaactcataacttcatatcttttttttttttttgtgatggagtcttgctctgttgcccaggctggagtgcagtgacacgatcttggctcactgcaagctccacctcctgggtttacaccattctcctgtctcggcctccccagcagctgggactacaggcgcacatcgccatgctcagctaattttttgtatttttagtagagatggggtttcaccatgttagccaggatggtctcgatctcctgacctcgtgatctgcctgcttcggcctcccaaagtgctgggattacaggcgtgagccaccgcacctggccataacttcatatcttaaacaaaagcttgtacctttcactgcatatagcaagtccaaaaagagtttggtttcgccattttggaagtgcacttccgtgtagagatgtgtatgtggtgcctatgtgtgtgtgcatgtgtggaagtgcgtgcataccgtggtgcctgtttcccaagtgttgccggccctgagcggggctgggaatgcatctctgcaatcctgcttggctgggggtcccagggtcccccttcgctgtcctcacatgctgagtgaggcatgtaaccaccttgtgctcagccggccaacagagctctgtctgctcaccctaatcctgacagtggtgcggttctgtccccagccacagtgaggaagctgcatgccagatgcttcccgcagggcacctgcagaatgattccaagggatacaccgtgttttgaaatggaattatatcattagtacctgctgggattagcaatgacattgggcttatccgtccttacatcacctcctcttgttcaaagactgaagggtaatgtgggagcccacccacgtgcagctgccccgctgggagttcttgttcgtgttaggttctgtgcccgtttgcatgtgtgtgcatgcatgtgtctacatgagtgtgtgcatatgtatatatgaatgaatgtacccatgcgagtatgtgcgtgtgtgtgtacatttgtgcccgtgtaagagtatgtgcatgcaggtgtgtggcatgtgtgcacatacaagtgtgcgtgagtacatgtgcatgcaaaacacatgtggagtgtggggttgaacaatagagggttttcactacaagagcaaatatttccaatgactgctggtcgcagtgtcctgtgctgcctcccttgtccctggggtccttcagtcccctctctggggagctggccctcctggccctgcgcctagctgtgatagggttggatgtgcctctggcacatggaagggcccagccttctgtggtcttgagagtgctttgctcagatgatgtcttcccttgcggtctggtggcctccccatcctgccaagcatctcccagcttccaccctagcccaggaggccccggggggagagaaggaaagccatgtgctgctctggtggatgtttctccatgcctccgggtgccttccaggggacaggtaccacttgtcactgacacacacgcccttcaccaccaggcgatttgctgattcacaacatgcttgacagtgtagccttggaaagtgggctttgtcccctggggcaagctgtttgaacagtaaccttggagcccacgagctgaccaagggcctgggcaaaggctgcggggttctgctctgactgcacttggtcaataagggcctcagctttacatgtgctctctctctgtttctctaacaggttggtggtcggggccagctgtatcctttgcaagcgtgcaggtggccgtcctgggaactggacactccttcccttgagtccctccctgccacccgcccttccggcaggctctttgctgcctcagatcggcacttactgggcctctcggcgtggaggatctactgtgcctggggacagtttgaggctgacctctggccagggattcctggaggctcttcctgagctgggacagctggacatggccatgaggcagctgggctgtcctccctcaagagcagccccagcctggacccattgcttcagaagggacaattagacagggagggtcaggagaggagctgcaggagggcctggggtcaaggggacatctgagggagatgaaagtccctggccgggcgcggtggctcatgcctgtagtcccagctacttgggaggctgaggcaggggaaccgcttgaacctgggaggcagacgttgctgtgagctgagatcatgccactgcactccagcctaggcaacagaatgagactccatctcaaaaaaaaaaaaaaaaaaaaaagccccaagccgctggctgagagcacaggtggaagaaagcagctgcctggcatctcccgtggctgaggtcctccctgaaccagccactcctctccatcccaactggaatccaccaggatgcaggcctcgccctggagccgggatggacagcacatgggagcagaggccagaggccggcctagtccgtgggtgctgcttggcggctccttgctaaccccagcctgtgcacttgagatgtggaggtgggggtcttgagttgggagcctcctccagggccagccatggatgggtggggtgtgggctgtggcacagggccctggggtgttgtcccatcatttccaaaattgggatctacagtgctccttagctggcaccccacagatgtggccctggagtgtgctggcttcctcaccgggattgggctggacaccaccatcatgatgcgcagcatccccctccgcggcttcgaccaggtagtgctggaggccccagctcccgcccctgtggctctgaggccttcctcccacagccccctcccaggcaggtgcagtgcagtcatgggccacgagtgatgcctgaatctttagagataacccttgaattggatgaggaggttgtccaggaaatatgcagacactcggccggagcgagggaggagggtggcagtggggcgcacagctgcacagaggcctccagccgaccacaggcacagtgaagggaggctcagcccagccttgtgccggcagagcaggtcaccctccgggtcgtcccattagtaagaggccggtgtgtgctgcagaagtgttagccccacctcagagacccccaactccctgctctccccttgcctgtcccctctgagggagtgggggtgaaataagctgtaatgtgtgagctggggtgagggacacagggcagcgctggctccgagacagcccgtgggatcttggcttctggacaggtgcgctgtgtacagtggccttcatctgtgtctggggtacacacactcatgtggccagcaggacgagctcctagattggagcaatagagattttctttttttagctaaaaactcttcaagggaaagtctcctgttaaaatagaagtctggagttgtcattgtggagatgtcaaacactccatgactgccacgaaggaggccccttgcagggtgagctgtgcagatctgcaggccctgctacaggtcctcggccgaccctcagctcacagagcctgaggaggtcacctgaggtgggaggagccaggcctgtcatctccagactcccagtgccacccccaggctgactcagagacgtgtccctccacccgtgtggccatgtgttgttccatcctaaagctatggcacactcccatcatgtccctcagtgcaaacccaccgagccctgtggtagggacgcagtgtctaggaaggcctcagagccttcagatgtggggagggtgagctggcagtggacggaggaggaaaggggcctgcagaatgggggccgtgcccaggcaaggaggatgcacagtctaggcagccaggctgaggggcgagggaccctgtgtcctggacaggctccatggttctccctcagagcctgggatggccatgccctccaggcctctggaggggtgcaggagtgatgaacagcctgtgcggcagcccctctgcagcacagccagccctgcccggcgggccagactcccacacacgccatctagagccagctggcacacccgcacaggtgtcagaggatgttagcagtgactgtttttctcctcttgaaaccagaagctgtggccagcttcactgctggtccgtgcaagtccccattgtcctgggaacagggcccccatctgtagctggacttggggcgcacaggcctcctgggccgggagggagaagcaggactctctctgtccctgatctggacctgagcctgctgtgcctacatttctaggcgggagcagagtctcctacctaccctcctggctcctggatggcagaggggcatgttggccacatgtggaggggtgggccaggagcaggggccatcttgttggaccagggcacagctcctgggggaaggcacgcttctctgccattggttttagtgaagactaagttttttgtttttgttttttaaagaaatgtgtagatgtaccaggatttggttgtttttcttttttttctttctttttttttggtttgagacagagtctcactctgtcacccaggctggagtgcagtggcacaatctcggctcactgcaagctccacctcccgggttcacgccattctcctgcctcagcctcccagttagctggaactacaggtacctgccaccacgcctggctaattttttgtgttttttagtagagacagtgtttcaccgtgttagccaggatgatctctatctcctgacctcgtgatccgcccgcctcagcttctcaaagtgctgggatcacaggtgtgagccatcgcacccggccttgcttattttttcttttagagatagagtctcactctgtcgcccaggctggagtgcagtggtgtgatcacagttcattgcagcctcaaactcctgggcttgagggattctcccacttcagcctcccaaaaggttgggattacaggtgtgaccgtatctggctgatgaagacttagttaattagcatctagagaggagcccacaggctgagtgaatcctgaccatagggcccagggttgaggacttggagccaggacaggggctagacactccacagagagcaagaggacgtagagcagggggcagggtgtctcaccccgtcttccgcacagacccctctccgcccttcattgaggccttcgagagcagggcagggccagagcctctctcccacggccacctggtcttcatggcctgtcttcttgtgctttgcagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtaagggcacgtcgagccacacgctctgtctctggtctccccgaggtgcatggagaatctttgccccacttcctgtcacctcccagggctcccccatcctgctggctgccaggcgggttggccgctccccagtgcacctcgagagcaaccgtgaaggcctgtggggcggcactcacactaggctgtgcccatcttgccatccccagcaccttgcatctctgcgtgtctccccaccaccgtgggacatgctggaaaaaaccagagaagagactgagacggcatcagccaggtgtcctcatcgaggatcaactaggcaatcatcctcgccttccctggcccttgagcaattgcttattaaggtttcagcacataaatcctacttgtcaccttccaggtttaagtcttggtatgtttcttttctttttttttttttttttgagatggagtctcgctctgtcgcccaggctggagtgcagtggcaacctccgcctcccgggttcaagcgattctcctgcctcagcctcctgggtagctggggctacaggcgcccaccactacacctgactaatttttgtatttttagtagagacggggtttcaccatgtaggccaggatggtctcaatctcctgaccttgtgatccacctgccttggcctcccaaagtactgagattacaggtgtgagccaccgcacctggccagtatgtattttttctttagcatattaaatgttttgctgcttcaggctttccagctaggtttttttctttttttgcgtgtgaaacagggtctctctctgttgcctaggaggagtgtggtggtgtgatcatagctcactgcagcctccacctcccaggctcaatcaatcttcccatctcagccttctaagtgctgggattacaggtttgagctactgtgcccagccaagctagtttgttgtttttaacataaaaatgatatggatttgaaagttttaaaaattatggtgacatacacataacatcaaattcatcatcttaagcattttaaagtatatagttcagtggtgttaagtacgttcatattgtacaagcagcatgaccatccatctctagaacttttccattatctccaaactgagctctgtccccattaaacactcactccctgctgcccgggcactcacccttcactgtgtgtctctatggatctgactcctcgagggacttcatgtaagtagaatcatgcagtgtttgtccttttgtgactggctcatttctcttagcacaatgttttcagggtgcatccatgttgcagcatttgttagagttagcatttgtgtagcatgtgccagcatttccttcctgttgaaggctgagttgtatgtgtgtccattatctgtcagtggacacttaggttgcttccgtcttttggctgttgtggatcatgctgctgtgaacatgggtgtgcacaagccgcctgttttcagcacataaaaatgacacagagtttttaaagttctgtccagccttctcgtggctttcagtgtttcccagtgggtccctttgggcctggcaggtcatcacatgccaggagtggcattttgcaggcctttccagaagtcacatttcgaaggcttccaaagacatcacccttccagtgctgggcagaggcctgggcgtttcccggccaggcgtgggctggctacaacttgctgggcacagtctggtctcaccttcttgctctctgtcaggtgtaggtccggttttgcatggggcagtggccgagcaggtgtggggagtgtggacacagccaggggatacctgtgcccaggcctgggccggggctgtctgacgggactggcaaggggcagctggagccaacagggatcgcccagacactgctctgtcccaggcctgctgcagaggaggccattgcagatgggccgccgcaaggagggctgcgggtcctcgtcagggtgggtggcggcacacacagcatgcctgctcagatgtcctacccacctcggtgcctggccgtctagtttaggctcctagttttcccaatcaccctgtcaacttgcatgttgaaggcgggagcaacctagtcagtgttgttagttctccgaggcctttctgtgctgagcctggtccgttgtcccctgcgagagcccaagatcagagccagggtccctctcagatcacctgcctccacctccatcagctaaccgggcttgcgtggggctggccaggggtcagtgtctcctgggggagggctcccagaggcacaagctgtgtcatagggtgatgcacttctgaagcagtcactcggaatgggaaatcagaaaggaaaccagcctggagcggctgaggcttcacttttgtgcagtggacacaagcgcagaggtgatgaccggggaggacctgagatgcctgagcgcacgcagggctcttggcccggaggtgatcagtcagcaagagcaatgttctcagccacgttgtaaaagtagattttaagtaagtttattatgataaacactacgaaggattaggtaacattttggactctggagtgtactgatggttctcatcctaaactccactttatttttctttcaaaatttatcctcctactgtcattcccaaataaactccactctaaaggggaggtggcgagtttctccctcccaccgcgccctagccctcctcctctgtctgctgacacctccgttcacccacagcataagggagctgttgccattgaaccgaggggcagccctcgaccaagcccatagggatgtagcagaccaatgggccgggggctgtgtccccggaaagccggggcgtcagcctggcaggcaacaagcgaggcccctccctactcagcagagctgccgtggcctgcacgcccatcctcccttgctaggagtctgttttatttttttgtactttcaaaatgagcatcccccagacagtctgcctggcatgattgatgctgggggtggaagcttttcacagtccttggcctctgaccctgcttcccgagggcggcgcggcttctgcgcgcctgctgggggccgctcgggcatgtgctgacttcgctgctgctcagagccaggttttgtaaacattcaggagccacttcccaggtcagcaactgcgagcgttttctgctggtttgtacgataagcctttaaccaagctttatttctacttgcaataaaggatgatccactctgggaggttaaaataaagcgccctaggggcggcacagctggcaatgccaacatctccgactctgcttcctgtaccgggtgtgcactacgtccgcacaagctgggctccgacaggaaggggggatgcctccgtgcccggtgcacacacacacagaaggggcccaggtgctgcacagagctcccgtgtggggccgagtgctggccctgcccgttgcccgtgtgcctggcgcctggccgcagctggcgaggaccatggacattggcattgcgaagtgggccctgcagtctggaagcagaggaggaccagagccccttcctcgacgcagccttgatctccacgtggtggattaaacatattagcagttaaagcagttaattgctgtgcagggggcccccgctcattgtttgtctctgaatcacccgcccacaccaggtgtctcagataatagactgggaacttcagtgaggaggatttcctgtctgcagatgtgccgattacagcgctgagtgaagacagtcagccagcactgctgcgggctcgaattcgcccgctgagttaaccagttgtggcctgaatccctggctgtctaggggagcagggccaggctggggcatcctgagcaaacgcctcccagtgcaggggcttctaagtgcagttaagtttagatttggttttaaagaagggacagactgcctctggactgcagccctgaaaaactggaagttgagatcttcatgtgcccctttggcgtccccagcccctctggatggttctctgtccctctcttgagggtgagatgctgaaggctctggcgtatccctccctgcaccacaggagtcctgcccatggccagaagagccagcagacacaggaggggactcgctaaacctgggggtcccacagccaggcagctgttgtgcctgagtgccagggagggtggccacaggtctgcctggggccttgtgatatggcaggtgagacgagacccagggaaggaatccgtctggatcttaccccagccactgaagctatttcctctttgggctttatcttagataactcagagatgtccacctgtgtgtaaaccagcatcagagcctgaaacacaacatgcatggagcatgggagcttggcttcccggcttcctcttggcaccacacagaggccacccccacagcctgcccctgtatagtctcccccacgtggcacgtgtgcctggaccacagccagagagactggggtgcccaggagatgatgatgggggctggcggtgcccaggaggggagctgttgccagggtgggctgcagccctgggctcctctctccacccaggcactgtttgctggcatgtacacggcaggcaactgtctttgctcagctgtgctcggctgatggctcccgtacaccgcagactcagctacacaagtccctgcggattgtccctctgttgagtgccaggcagcaggaaagggcagaaagcaagaaccaagctggggatgggtgggagcatcctaagcctggtgagagggaaggggcggctcctcctggatgccctctgtgctggtgtgggtgcagctggggcttaggggccgcggtgggtgtggatgctgcccgggcgagggggctgcggtgggcccatcaggactgctctcagggatgcgccttgctgcagctgcgtgaaaccaagtttgtggctatgctcttcccggtggggatgggcccagcagtgaccctggcatccacatgcctccatgctctcagggtggagtggccatccctgagcaggtgacacggatcggaggcccctctttgatagtctaacacctttttattttagtgcaaatttagtttgtaattaatgacatcaagagagacccaaatctgcctccattgtgagtttgatattttttgaagtggggccaagatgaacattcatggagctcttcctatgagcggtggctgcggccttcccctccacaccacgtggccccgggcgtgcgctgctgctcctgagacagcactgttggctcagccctagctcatggtggtgctaacacctcacagaggccaggccagagtagcaggaggcagcgccctgtgcttacccaccagcctggtgccccacgcttggcttgagggctagttcacacttatgtccagagcccacagctatctgacaggccagccggcacctgcatacatggttgtccaactgggtcttgttaccatgacaaattcagtacttaatgattagaactgagtggaaaccaattaaaaaaaaaagaacaacatggtgaaaagtcttctagagataggtcagcaccatttatgcatattaccatgcaccctctaatgtctgcaggtgccctggggcagccaacctgttacaattgcaattatgttaacaattgttaaagggccgggtgaggtggctcatgcctgtaatcccaacactttggaatgccaaggtgggaggatcatttgagcccaggagttcaagaccagcctgagcaacagagtgaaacctcttttcaaataattaataataataataataataataattgttttttgtttgtttttgagacggtgtctagctctgttgcccaggttggagtgcaggagcgcgatctggctcaccgcaacctccacctcccgaattcaagcgattctcctgcctcagccttccaagtagctgggattacaggcacccgccaccgcgcccagctaatttttgtatttttagtagagacagggtttcactgtgttagccaggctggtctcgaactcctgacgtcatgatccgcccgcctcagcctcccaaagtgttgggattacaggcgtgagccactgcacccggtctaataataactgttaaagcaataatgaccactcgccacagagcacgctccttcctgggggtcctctgggcctgagctgggggctgcgccgtactccaaggctgactgtggggtcttacacatcataatgcacataggcagcttgagtaggaaaggcccttatgctgcctgaggggaagctcacccccaccccccaaggagccgccctgggtatgagacatccctggaacggcctaggggtccctggtggctgctggcagtcacagcaagtggccaatcaggtcccattgaggcccaggggctcactcatttattcaactaacatggcgtctcgatgggacctgaggccagcagggcaggtgcgtccccttccccctggtgggctcatagctgcgggtaggggcccggggctcattgagaaggtgcgattccagaaaaaaaaaaaaaaagaagataaatattttaaaataataagcttcaagaatctaagtccagttccaaaggcatacgctcctctgtgcctggtccaaggtgcctcactggggcaagtggcaggccaggccccgtgagggtggctggctctgggggccacatgcctcatgagacagtcgccaggtggcccacagggcctgtgtgtgaagccgtgcccgcctcgcatcgcccaccggccctggagcctcccactcccacaccctcgtcctcaggcgcagtgcttggccctggctgcctctgtctggatcacagccactggctcaccctgctgtactcctgctggcacttacctctcacctggggcgctgcctccttgctcttctcttgggaaaatgtgtcccaggcgggcgtgaaatcagagggcatgcctgttcttcccatcatggatgagagaggcgcatgatactgcatgcggctggccgtccccgtgtccctgtgtccatcagaatagatgggagtgacccatggtgactgtgtgggtggtttttgggcttcagccttctctggtccctccttggggccaggctggctggacaagcatggtggctgccctccatctcctgggccattgacagcagctggtggggctctcattgtgatcagaggagggctgccctgcacggctgttcctagcactggccacacatggagatgggctgtcctgcgtcaggggtgctgcactgctgggcctggggctggaggcagctccgggctgcagagatgctcagcccagtgcttcctgagtgtcagtgttgtgggccagccacacatatacataggaagtgagcacgtccatttgtacctggaattactatttttttggcagaaggacaaactttgttgggcccatcagccccaattctgaaccaagtccagtgggcagcaatgagacccactttgctaccagcagagacatctctgcagtggcaggttcgccaacgtgccagtggttgccatctctgaagggacgttccttggggcttgcggccatactctgcaccatggtcagcagctcttctttgccttatatgtagtgggcatggcctgccttcaggatggctggtcagttcggccacctctggctcccacattgaccacagctctgttggctgagatgatcctcttggagggcagcttcatgtaagtcttcctggtttccgggctaggggaggtgactgcggtgtagttctcaaaggcccaggctaacaagttccagtctcagcctctcctccaggcagcgcttgatggtacaggtgtggtgcctgcagggaggacgctgccgacgtccagctgggccctcttgctacagtacacaaacagaaattggcccgtgtggaggcccttggtggtgatggacagctctgtctgctgcttaaactggtgtggatcctggagaccatctcagcaggggcatgtccttcaaggtgcccttgatgtagctgtgccgctcagctaagtccacagcatgcaggcctatgagccctcctgcttcatgtgcacaaggaacacagagctggtgcccttcctctgcccacgaatcccgtggcccacgactgctcatgaatacagcctgaagagctgtacctggaattttaatgcccttgtcgtttgcagaaaatatgccagagtgtcatgtatccattacgtaataagctcttacaaagaaggaacatggtgaagatgcctataaatggatgagaaaaggcaggaactggtaatttacaaaagaggaaatacagttcataaacacgtggccaaaaattacttcatcttactagtcatcaaagaagtgcaaattaaagcagcatgacagagagtgctgtgcgccgcctgccccaggaaggaacagagtctaaggactgccctgcgcccagaagcccccactcagctggccgcccttcctttgagggtctgccccaggaactcaactgacacatggcaagctggtgccccaggtctccatcctggtggtgtctaggaagcagagccttgagagtgcctgtcctaccccaggaggggccattcagcagcacttggcaaatgctgcactgggcactccagagccaaggcttcgaggacggagctgcagggagcacagagccgccccatggggaggcctgcagtgggccacaggcacagctgggaaagctctgagcacaacatgcagggcgaaagacaccggtgcaggcacccttctttccctaaatggcctgaatagtgcacatttatcctggcataggagggaaatggtcgggagctgaccaggcacaactgctttatcctggcataggagggaaatggtggggagctgactgggcacagccacctgcatcctgctgctcacagcattcgggccccagtgggtccccaccttggcacaagtcgtccaacctcctgcagggctccaggcctgagccagtagggcctaggacgcctgattggctgtccagcaccagcagggagatctggcccttctctggccactgcccagtcctttgctcagcaagacccatagtggggctcagggcctggtgtcctgccatcagggctggccacggctagggacgtggccccacccaagtggagctggcctcttccctgcacccactcccagccacgtcccaccagcccagcttctaaccccactgtgccctcggctgccctcctcagggctgagcctgctgcctgccacaggccactcactcttcttttgctgttcattcccgaagggctgtggagtccctgcagggccaggcgtgtctgtgccgcgcagcccactctcccctggccatccagcctgtccagctgtcatgcctttcacattagtggctccattacattcccaccgacttcccagagtgatccacagagcatgtgcggaagagtcctggctttggatgggccacctatttccatgcctcttttatctcttgtgactacttttaaatttatctttatttccttcgggacctggggacagggtttggtcagcacctgcaaggtctgtagttgccatagtgccatagttaccatgaggaacatgatgagtgctcttggcttcccaggaccagccaggcaagcgtgcagaggagagtgtgggtgcagcgtcagatgttctgttccggcacggagcaggcaccaggaagtgctgggcctggtgggctggacaccaggttggagagggaccagacggctgagcgtgagcccccggcctgcagggaccacagcccctccttcgtgccccagccctgcccatggggcccagctccttcctctgatgtgggctggcatcccctgtgtctgggctgatccccgaccggtgccagccctcccggcacccaattcctgcggctgagcagagcacagaggctggagccggcctcccgcaagctggcttagccaagttggtatgttttgactcctgccccgggacagcagctggagacttaagggttccctctcacgggagcttcagcttccagatgcttaggtgggcgccacccgcataccggccagcagctggtttgtcccagccacgatgagcaggggagctatgcttttgaggcaaaattgccttcgccattggtggatcatcctgagcccctgggagccgagagcacctggggttgggagggaaaagctgctgtggccatccgctggcctggcaaaatcacacccatctgagttaggggagaaagggacctctgctggctgttcggctatgaagaggcccatgcggtgccctctctccgggccccaggctgtgtggagactggcagggggcagctgtgctgaccccctggactggccatcccctgcccctcttggcctttgcacccaagagcaggatcagctgagccagctgccccctagaatgggcacggtgtagtttggacactgccccttagctcagctccccttggccctgaggtctctaggctgggactgtgtgccaggcagccacgaggggctgcagcacagagcaggtgggagacccggctgctagctctgctcacctggccctctactagcgggttacgggggcttgctttctcctaatggggagagaccttcaagccctacctgggcagagggccagatcccaggacttgagcattgttggggtacagtccagggtgtggctggctcctcttcagcttgtccagatagggaggaggccattgggagccagcaggtgtcccttgaaggaggcccctctggactcttgaggcctgggagctgatggatctcactgcctaatggtatcaggctgtggtgctgcagacagatgcagggaggccaggcaggccaggtgccaacagctccccatgaagggctggtttctccggatgaagtcagtaccagagccactggcactgtgctggtggccctgcagcagggcctgaggcctgggcatgcggaagattctggagtcccgcgcttagcactctttgatgtcagggagccccagcattggcaagtgcctcttcctttcccgcgtgccaggaaccagtctaaggccgactccagtttccaccggtggcacccctgccttgtctcctgtgccggctgtcatctgaccagtgtccgtttcagacctgcctgccacctcctgcagaggccaggagcccctctacgctgctggtgcttcacatttggccagttctaagtggacattcttttttcttgagacagtctcactctgtcgcccaggctgaagtgcagtggtgtgatcttggctcactgcaaccgacacctcccgggttcaagcaattctcatgcctcaccctcccaagtagctgggattacgggtgcatgccaccacacccagctatttttgtatttttaatagagacagggtttctttcttttcttttctttctttttttttttttgagacagagttttgctcttgttgcgcaggctggagcgcaatggtgcaatcttagctcactgcagcctccacctcctgggttcaagcgattcaacctcccgagtagctgggactataggtgtgcaccactacgcctaggtaattttgtatttttagtagagatggggtttcaccatgttggccaggctggttttgaactccagacctcaggtgatccacttgcctcggcctcccaaagtgttgggattataggcatgagccatcacgcctggctgagacagggtttcatcatgttggccagcctggtctcgaactcatgacctcaggtgatttgcccacctcgtcctcctacagtgctgggattacaggcaggagccactgcacccggtctctaagtggacattctgagaaacagtttaaacacaaccgctctaggtcaaagccactgaagataacctttcagccccctctctgtttccttcaggtcgagtcccagacaccagaagtctgaatttggagaaggctggggtagatactagccccgacactcagaagatcctggtggactcccgggaagccacctctgtgccccacatctacgccattggtgacgtggtggaggtacggcatgcgtcccgggaccagggcccctgcccctgcctgctccaccacccctgctcgctgggctccggctgctgccgtcctgtaggagagaaacgacactttctctgatgacagaggctctgggccaaaccccagggccagcctgtctggagttctggggcaacctggacatgggcctcggctctctgcctttcctttcctttctgtggtgggagtgtggatggtctaaagacagctgcaagcaccagcagcagacgcctgctgggaatggggcatgggtcagctctgcacgcaggcctcaacccctggcaggtaggctagaggcataggcttagaaatgccaccatggccttggggccgtcctgtccccacagggttgagaggcaggtctagttcgggcccacctggccccgccctccccgcctcagtatcctctggcttgcctctctgggcatcacaccggggcaggtcctttgctctcagctgctgctgctgctgtgaagtggagaccggtgccagtctttcctgggtgggggctctggagccctccttacacatggccccagtaagggactgtggtggtcagtcttgggatactgcaccctggcagcctcaggagtgctcggcctgtcctgcatgtgtccagcacctgctgctgaaagtggctctggagggtcgctgagagcttctttgtagcgagacctgtcagtgtctgcgtcctggggctgtggtaccaaatcaccacacacgggtggcccagaacaacagacatggattatctcacgtttggggggcagtagtctgaaatgaaagtgtcagctggggctgggtgcagtgtctcatgcttgtaatcccagcactttgggactccgaggcaggcagattacttgaggtcaggagttcaagaccagcctagccaacatggtgaaaccgtctctactaaaaaaatacaaaaattagccaggcgtggtggcacgtatctgtaatcccagctacccgggaggctgaggcaggagaatcatttgaactcgggaggaggaaggcggaggttaccgtgagccaagattgtgccactgcactccagcctgggtgacagagcgagactccatgtcagaaagtgtcagctgggccaggctccctcggaagcctctggggtaggatgccccaggcgtccctcgggttgtggctatatcactcctctctctgcctcatcgtcatgtgacagtctcctgggtgtgtctctgggccctgatttgcctcttacagtttctctgcaattggacttagggtccaccctaatccaggatgacttcatttccatccttaccttaattgtatctgcaaagatcttatttccaaataaggtcacactctgaggctccaggcagaccctgcagggtcctgtagggcccatctagccgacccgattgtgtggacagagcatgtggctccatgtgcctcagccaccctgcagccccagcttgcttagctggatggttcagctgctcagtgatttctgcaagcgcagcctctgcctgtggaccatgtaggtgcagtggtctctggttgcagggtctgttgaatcctgtgggcgctgcaccctgagacagtgccatgtgcatctctgtgcacagcgggaagcctcccttctgtctgggaatctgagttttccctctgcaagtgtgtagctcccaggctcctgtgttggaaactggaacatttcaaaccgttttgccagaaatgcatggcgcacacaaaggcattctttatttaaacattaaatccactctgtcagaaaggtcgttctgaatagtccaaagagttaacacccaaccagtggtcccttgagcggctgggaagagcctgtgggcggggcgggggctattgtttaatgagatgttgtgtgctgtgcgccgcccgccgggatgtttccgtagttagtcaggcctgctggaatgcgcaggctgcgctctgagtttatctccacggatctctatgcatttctggaatgccaaacaacatctgcatttcctgctgccatggtgattggcagcccatcccagaggacggtgctggaacccccaaggctgggcacaccctgggacggagggatctccagcacagcgacattctgatttggaatttgttatggactgtgacgtgcagatcaagctgcacgtcaggagcacatggaacgctttggggtccctttttagccggggattccagtgaatgaaaacggtagcaggggctcttttgagcttggtcatggggcagccctccgaggtcagcaatgtgcagaaggggtttggagagaaggcttgagcatgtgagggtggcacggccagcctcatcagcagcggactcctttcccagggcagagtggagggcagcaaacaggagaatgagcaacctacctaggtccttgggatgcccctcaggaggacgagctctagggggaatgctgtacgtcaccatgctcggtgccagtgttggggattttctaaagggagatgcccactcggagggcaaagggtgatggcataggggctgcatataaccccggacatggtgctgacgtggcccccctgtgccttccccaaggggcggcctgagctgacacccatagcgatcatggccgggaggctcctggtgcagcggctcttcggcgggtcctcagatctgatggactacgacaatgtgagttctctagcaggacgccacgtgcagcctaggacaggctgagttcgaggctagctcttctggggtgaggggcctttgtgcgctgtgtgtctgcatgtagatgtgggcatgcgtgtgtgtgcgcttatgtgggtgtgttgtacacacgtgtgtgtgcatgcatgggtgtgtggctcagttctgagagtgtggcgcaggcgtgggcaggtgggtcgcctactgtgcttgcagcctgctctgggcgcatctggtcctggtctgtgatcgctgctctttgtgtcacatgcagtggggaacttcggttttcggggcccaagggccctccctgactccagacctgctttcaggttcccacgaccgtcttcaccccgctggagtatggctgtgtggggctgtccgaggaggaggcagtggctcgccacgggcaggagcatgttgaggtgaggcctgggagcagcacagctgaggacagtggcgactccacgacctcaccccatgctctgggcggaggccttgtgagcagggtgccaaggtctctcctttccaggggccctgagcagtggctgtgtgtagcgggaagggacacgttgggggcagcctcagaagtgggggtgcctgggctttggcagccttggggtgactgggcttaggtgcctctggtctctgccaccatgtgtcacagcagtgaggggaaggcccttggctgccttgttctgagggcaaggagaagccctgtggcccagaagcccccagccccaccccagccatgctgcaggggtgcccagcaccagcagggtcaccaccacggtgccacccgctcccctgctgaggtcagctgagcactggccccactccagcacacagcagcttgtccctgaaagcaccagggccccgaagatgcctctgtgctgtccccaccttgcagggccatgaatctcactctacccagaaaagtttctcccaggggcctccgacctctgcttccacccccaccccccccaccaccctgcacctcgtcttcctggactgcccagggtttctcccaggcgagagccccccgccccccgccccccaccacatcctgatacccatcctcttccagcttcttccaggctcaggcactcacccttgaggaaaggggttttcatcgagcaagcctgctttgggggtctgctctggcaggtggctgtggctccggggtggcctggagggatgcgggggctctgaagcctgccgggccgtggtagctggaagccttcggtgcggtttcatcttgctgccgctgcagcttgcaggcacccagagaaaccggagcctgcagcctgggcggtggggcctgcggcctttggggatgagacactgggctccagggctggccccttccccctgcaccccagaactctccatcaacaggacgggcctgacaggccagccttccccgaggcactttatttgctatttttgtttgattcatcacaagtgtgctgggacatatgttcctggcattttataatgttgttttatgtttcacaatgttgaatggccaaatactctgtttgttttcttttcaattctgtcttagttagaacaatattctctgaagttccattaattaataatggctgtacagcacatgtgagggccccactcattttttacttggccgcagccccggacacgctgtcgagcccttcaggggtgctgaaagcctttgtccaacagctccggctccggtgtggccacagcggccttgctccagtgagggccaagcaaacaccagggtgcctgagggagcccaggtggcctcctgctcacccattcttgcctccaccatttgttgtgggtgagctacgtccacccaggtttgctgtgcctggcctggctgcttggattgcctgatgcctgctctgctgctgtggtttacgggggtcccaggcctgggtgggacagggtctgtcctgcagagcatggctccagccactggctgcctgcacgtgagagggcctgcacacaccccgtggccagccaagccctcatccccatcccagaccagaccttcaggccagatggatggttcctgcccgccatgaccctgccttgcccatgcagcctgtgggagctgcaggtgccacgaggtttgtttgtcgcagcactgatccagggttggtatcctgtcctcaggtctatcacgcccattataaaccactggagttcacggtggctggacgagatgcatcccagtgttatgtaaaggtgagcatccctgtggcccagggtgctgaggatgagagggagggtggcaaagagcctggcagggtgaacacccgaggactggccccacccatgcctcccaggcagggtgcagggtggatgcagggtggacgcaacccagccccctcctgggctggtggctgagatgtgcggctttcagatggtgtgcctgagggagcccccacagctggtgctgggcctgcatttccttggccccaacgcaggcgaagttactcaaggatttgctctggggatcaagtaagtcccgaggaatgcaggctgcgatgcgatgtgcagctgggtatccctcgagtgccggcagtcctacagtggagagctgctgccactcttgcggcatttatgtggccttcgtgggtttgcagcagagattcctcaggcccctcagacagggcgggttttagggggacaagaggcggttctgccccagccagacgctgttgagccagccagagccaggtgaggtgtcccctgtggccccgggtcgctgctagggcccttgcccacctggccaagcaccacgccaccatgagcagagtgccagtacctggagagccaccccagggctgctgtgtgtcttctggagctggggccattgcctgggtcttgggctcaggctgtgtgttttcggggtcccggggtcaaaggaagccatggcaaaggctctgggtgggttgacaggggtagttggaggttgggacattgtgcatggcctgagagaggtggctggctggatgtggggcctgggaggtggtggtgtggtgaggccaggatgcgctgtctgtgggtaaagcagagagcagaggcctaaggcaggactgtgcctagcaggggaggatggaacagcaggaagccaggccagggcaagccagggcgtggctgggtgggaggtgggctggacgagcactaggcatctgctgggagggaggtggatggcacccacgggtgtgggcaggggtcctggctgctggctgggggtcaggggacagtgaggagaccagcagcctctgaggccctcctcttcccgggggtgggatgctgtggacccccctccctgtgctgaccccgcctgcctcccccatcccccatgtgcaggtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggtatgcaggtggggctggctctgtttgaggacagggcatgtggcaggggtgcaggagccctggccatgggctccctccaggtgtacagcaaggctacacctgccacgccacccagaatgggtgctccatcctgtaaccaggccacagcggtgacaggcagaaggggaagttcccaggggcccaaacctccccgggggaccccagaccccggcctggccacagctgctccccacacacaggaggtatcaagaaacggggctcatccttagcagcctatcccaggtggatgttggcgtggaaggtgtcccgggtgggctaaagtcgggcatctcaagttgctgccccacagggggctgcagtcgggaagctggcctcccaccgaggcctcccaccaaggcctggctcctgcagagttcagcgcccgctcatttccctatctcccagaaggtggagacgctgccctgtgatggccggccctgcccagcctgccctgcacatctggttctgttccagctctgcagagccaggctgaccggggggcatgttgttcatcgtgacctcttctggggaggaagaaactggcaagggctcctggcctctgccccagggatgcctgtgccagagccccctcgcctcgtggtctaatagtgcatcctccggcctgggctgcagggcaggggccggggcagggtgggccctcagcccgtgccatccagcccacctggggcacccccatggctgtcagcccctcccagggttggggtgtttgggctccatctctcccccggggctgaggtggagaccaggcagagcagtgggctccccccaagatgcctgtggacaggctctagggtctgcatggcgccgaggggctctggggaggcctctctgggggtactcagggccccctgcttcaccgtggccgcctccccccggcggggccgcgctcgatagggataaacaaagggcatcctgaggaaactcttatcagaacattacacctcccagagctgttttgttaggagcctgctataaatttttatcatttcaaaatatttttgtagcaccgcgtcgctccctgtgacgcatcgccctggggtggggccattctctgctgggtttatttctcacccatctcccttgggggtccctgggtgtggcagtgggagacatagctaggctgatgtgaggggtgggtggctgacctgtgctgaccttcctgttgttggcaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaagtgtg

SEQ ID NO: 37500 - DNA, 377737 bp, Homo sapiens
gctgtgccgcaccgaggcgagcaggagcagggaacaggtaggaagctggacttttccttctttgcagataaaataaagaatgcgcatttccatgctgttgcttcccttcccccagccccgcccagccctcgtcacccccaaatctcctgtggtccctgcagctctcgccgtgcggcgcgggaaggactggggcggaggtggctggggtgcggggaagcaggggtgcgggatgccggagccctggggtgccgggcaaggcaggacggcagtgccctagaagagggctccgagctcggggtctgtgtctcgtcaactttcctttcggaggctgccgccgccagcgccgggaactcgccccagggatgccatatcgcctcggcaggggaggggtggggaagcagagaggtcggcagcccggggcctgcaggtctttttctcccgacgccggcccgcacctgctcatctttcccatcccacctgggcgcctggctagcgcatcccggaaaacctgggagcggttgcggagaggggaggaagcgacttgtttgtcccctgacccctctgttaagatctagctcccttcaggagatgggggtggggaagaatccctgcaactcgaagggcacgttccgattaattacgtctccgttgagaaggcaccggcccttctccacgatctgcggcaggtgggagggagagaccgcggagccacggccccttccctcctagcctggcgctgtctacgggaaccaccttcacacctagtttctgaaaggtggatttggcttcagggatttccagggagtcaagtgattgtgcccggatgggctccgagcggctgcgaggctgcctccctaggtgaccgcatctgggtagtaggtgttggcccagtgccggttcctgcaggagtcagattgctgggagcagtaggcagaagaattgcagagagatccgacgctgcatcaccctctgggactgatgacaccctgctttgaaaattcctgaaaaattgggatgatgggaaagagggaaagcggatagctgcgacctttccttatttatttatttattttcatgccaaaccgggcatgggtattcgtacgtgtgcttgtgtgtgcacatctccaaggtggagctatatatagctcctgcatacccagcccggcttccctgctgctgagccggctgccttggccttctcaagcaatctggaagcactgagtgggcggggcaaaagggaatccaattctccattgggggaaaagccggagaagaagcattcagactgctgaaaccctgcgtgaaataatgtttttgtaactcacgtaaagatcaatatttcatatttcatgttttcaatatgtcatatttcatgttttcaatatttcagtattttgcaaacattcttagagtgccaatataatcttcatccatttcgccgcatttttcggtttctaagtgtacatatgaaccttaccagcccgaagtgtaacgcaaatcaaattaatacatgccgtatctgggatattttattagactcggcataatggtttggttatttggtagtaaatttatttcagtggtaacttatggctaacagcatttggggatctgggaatggatccacccactttccaggactaaggaactgctagaacccttgcgggggtagatgtgaggtatttctttgtacagattttacatgtggacctgatatttaaatttgtactgctttttcatatcacatctatttgtactatgtgaactttcttttatagattgatgtatgtgcatttatctttgccattccctgaaattacttattcctgatgacaacctttccattttcacagatgaagaaactaagattcagaagacacaagtgattggttgaaagtcttctgaaaactttaatattccaacaacctgccgtgtaattatactgcatagcagtttcccctcaaatagaatactttttagcttcccaggatttttggtcctggcaacaaaatgtggttaatgttgataccaggaacaatataaaccaagtttattcggttctagtctgacatgtatccctacaaaatttaattctgtgttttaagaacaaaattctaacttgccaagtcattttgaagataaattatttaatctaccaagttaccatcataggcagtgcgagctggcttttaattttgctctgcaacttcctgatgatctgatttggagcaagataattaaactctgagaatctgttttcttgtcttcaaaaggaattttatagcattgaaatttcaggttgctatgagggccataaaaagcatgcatgtttctatcatggggatgggcgcatagtgggtcattaataaacagggctactggtaataataacaatacataggtatgtatcaactaaatgcattttaaaattcatggttctaacaaaacgatcactcctcttcagaatctctagtagactattttcacttgggaacttaatcatacttagtcttattttgttgcttaatcctcatttgtatgtctgatttgttttctaattaggaagtactttgcagaaaaagactacacttataatctttttgtataccccaccacattgaacacagtcctataataagtagccttaaagattcttgttcaggaagcatcatcctaagaagctggatgggtgcagcaatgatttggggatatttttttggtagaaggctatgccttgggaggaaacttcctctggctttatgatcctctccatgaggagtaatggatgacataaggtgtttctatatcttttcatagaatgactcggttctacagtagggattatgactatgtactggttctatgtattctcttgtatcttgtgtcccttgagaccaactaggaagagctgaaatagacaatttatatttctgtatacaaaatatgtcctgtaattgccttatttcaaaaaaaatcaacaaattctccaatttccatctatttctacatgtaaattggccatggtctctatcatatcccacaacttattctaactcaccagtaagctcctcctcaattccaatgtttgttttctttttattgatgtattatcgattgttctcttctgaccttctattttccatattgtccatcttcttgaaattttgctccttgacaccacaatgctctgatagcgtacttttttcttaatttttctaactttcctttctttgtctccctcttatcttctctttctacttctagctttcaagcaaatcccccaaattgatgacaatttatcttattgaaaataaagttctccttctgcatttccattcctaatctccctcccattagccatttcctttacacttaccctatcggctaagagcacaggctttgggaggaagcctgcaggtgttaatatttatgtatcatgatgcagttaagcgaacatcagcaagtcaactggggattatcatagcacttacgtgagaggattttgtgatttgtaaaatattaagtgagataatgcgtgttaaacattcaaaataaggtttggcccatggtaattactcataaagaatagctattaataatagaagtgctattgtagcaattgtaatgcacaaggtgaaaactggttttgctttttccccatcaataggcatcattcctaaactggcttttatcaatggagactacaactttacaggctttctggcttgtggttagttactttttaagactttctttcctctagtccaagtgttcaccatatagtcagtaattgattcatttttattttcaactctaatttgtatctttctctgcttattccagcactagtttcttctggcactccatgcctggatgagtccagtaggcaagttatcaaaacttccaatttataagtctatctgctttaatctaagatgccatgtattattggtataatgtgttttcaattttcattagtgcttctactttcctttgaaactttcactgtactttagttcgtatcttaaaaagcactgattttggagcaggagactcaggttcaactcctgacaacaggactgatccgttgtgtgaccttggaaatgtagcagcaggaggatggggcattatttcacttcaataatatgaatgaccaactgtgtaaagttacactcaaaagtctatctatttaatattcaattgaaaataatatcttattattataaggacatctaaaatcattaaagaaatactgggaataaagaaaaatccaccaaattccgcagtacaaagagatcctatttcaatcttctagtcttatttctattaatataaataggtatttttcaattatagatttgagtttacagtgaacattcacttttgtatttagctttttaaacttaatataccataaacatttattcatttcatttaatattcttactatccatgtgttttttggctgtcaatattctatgatagatcttcagattgttttcagttttgcatcgtcaagaacatgaacctttgtatacattaatatttgcatttctgaccatttccttatgacaccttagaagttacccaggcaaaagtgtaaatatttttagcctcataacacttactgccaaattgcttcccccaaaatgtaagcacagatttattctctaccagtggttgtaccagtttggccatactctcattaacacttgatattatttttaaaaattgggatcattttgatagtacaaattgtgtatctagttattcttctgagttattgttcctatgattttggatgagttcaaaaatgttatatttataggttctttgtattttttaatttgtgaatttcatttgactctttattggagtgttcatattttcttcatgtaataggaaatctgaggtatactgcaaaaattgtctgcatcttgttctttgcattttaaaaaatgctttctaacacacagaaatgtatagctttactgtagtttataaatctatttgcagtagtgtctctttgtagctttcaggttcagaaaactttctaccacttaacggagaattgaatataaaaacaacatgtgacggtgctattgctgaacttctttcctcctttgaagcagaatctggcttatgtatatcatatgtatatcccagtgcgaaatggctctggggacacataaaatccactcagtctattaagatcctattattctttaggcagctctcccatgaagtgaatagtaccttaattctttctgagctactattgtccattttaaaagagccacagggcagaatgcactatggaagatattaatggccaggttactcagccagagcagggcacattgtttgcacaattatctgaatgactcaggcactaaatctgcttctgccaggattatccagatggtccttaactcagtagataatttttcactcctgtacttgattttgatggtgtagacctgagcatgtcaccacttttcctgcactgtcttgttactactcaatttgcttagggctggttgctttagtttcttttatgagaggcaggtttgcccggttctccagagcataggtgttaagagttatgcagagctttgcatgaaacctagctcagtcagttactagcagcgtgctttgaggccagccacttaattttttttttttttttttttttttttttacggagtctcgctctgtcgcccaggctggagtgcagtggcgtgatctcagctcactgcaagctccgcctcctgggttcacattattttcctgcctcagcctcccgagtagctgggactacaggtgcccatcactacgcccagttaatttttttgtatttttagtagagatggggtttcaccgtgttagcgaggatggtcttgatctcctgaccttgtgatccgcccgcctcggcctcccaaagtgctgagattacaggcgtgagccaccatgaccggccatgagaccagccacttaaatttttttacaacattgttttctgtgtaagaaacatattcagagtttgaagtccctatttcattctcctccctcatagtcgccttcttctaagtacattctatatgtcataaccacagttgtctttctaaaaccaatttcatcgtattcttcctctgctgaaaattttttgagttagttcccctttttttgtattagtaagatgtctgaagtcttttgcattgcacctaaagtcctttattaaatggtacgtggtaacttctctagattcattttctgattaatcaaatttcttccatctccaatctcccgtaatgtcaatcaactgaacggtttgccttctcctaatgcatcttgtttcctcttttctcgcaacaccctcccatgttccccatgttctattctctactataaataacctgttttcttgtctgctttttaactgacctaaccttttcatgccttgggtcaggtgccaccatttcttggaggacttcccctgaattcccagtcttaaattttgactccctgtggatatccctgccgtgtcacttaccatactatattgtactgattggttacttgtctcttgcctccaccgtaagtccttgaggatagacaccatatgttatttttctttgtgtctgatagaggacctgacatagagttgatacttaataaatattttctgaagaaatgaataaaagaaggttaagactaaattagtttttaggatttcaacaaatgaaggattcatatctttaccctggaaaccaatcaataaaagctaaaaattatgtcaatcttcacaatatttcaaaaattaacttcctggttttgttgatttatacagagtaaataaaagagagtttttttttaatgaggaattttgtaatgaaaagcatgcctaggacagccaataattccaaattgctaaatcagtcaataaatatcttttaaataattctgcattttaaaaggaaagaggaatgcatagttacatggataatgtcgatgtataaatttagctgtgttggaattaaataatggcaaagttaatttcacttttctttatttaataaaaggtcttccattggtgtcatctttggtagattacaaagcatggtcacatgcatagccttatttgatccttcgtaacagttttgaaagttagattcaaaggcatggttatccacatttacagataaaaaaaaaaagctcagagaagtaactaatttgcccaaggttacacgttagtggcaaatctggacaagtaagatgatcttgctcatagttgagtgtcccatgtgttatggttggcccagaacatttcactgagagatgactgccatgattttgtctaggttaaggacaacaatcttgataataataatcccctgaaagtcctgagcaatctagtaaaaatgtattgcattattacctatatagggtttttacttagatttttagtaatctgagaagaaaccagctgacagaactttttgctttaaacatattttaaagtcttatatttagttacttgatcatttagaacacacacacatacacacacacaccatattaccctttcttttgtttgttttgaagtatttgccttttatattaggtgacaagtacaatgctctttcccttactttttttttaaaacttgaattattaaaatatttttttcagccaggcatggtggctcacgcctgtaatcccagcactttgggaggacgaggcgggcagatcatgaggtcaggagtttgagaccagcctggccaacatggtgaaaccccatctctattaaaaatacaaaaattagctgggcatggtggcacatgcctataatcccagctactcaggaggctgagggaggagaatcatttgaacccgggaggcagaggttgcagggagctgagatcatgccattgcactccagcctgggtgacagggtgagactctgtctcaaaataaaaaaaaaaataaaaaataaactggattttctttgtttagtagacaatgttcaactttagtcttcaggttttggcttagcatatattctgtgtaatcttggagaaccagataggtcaaatgcattttttaggaaatagcacaagtgatgaaaaagaaatttatgaaaaacagatgggtacttagtaagaatggcaatctatcctagtttgaaaattacaaacaccgagatataagattgatttttaaaaattgacttgtgcaaacatcttctctataattgcacctcaattactaacaatcacttattgagcactcactctgtgttgggcatttaaaaaaaaatgtgttgcacatgaccatctcaaaactttacaaaaccagtgaaaaggatttttaaagtttattattccgattttgcagatcagggaagttagttattaaaaagttaatgcatggagaggctagaattcacacccagattgtctgactctgaagtccaagtttttaattgctgtgttattcagcaccaacccccagtgctcatgatagctggttttagtactttgtgagtcacggtttaaaatgctgctattctaagtgaccggaatctatccctagaccctcaaataaatttagtattaatacaaggaattaaatcattctaaatttgcatatgttttatttatgaatatcttattgatatctttcactacagtaatttacatggtgcagtttcccaagcatgaattggaccattacaatgtgtcatttaaatatgcctctaataggccaatcatttgaattttgacacaagcaccagaagtttttatgcatttctgccctaattttgctttctaacatctcaaaccataaacagtaattctctcctaaggcttctaatctgatagtatttaattgtcatggttactaaaagtacagatttgttaactgtaacagacaagatgaatattataaataatatttataatattctagcttgaaaagctgtttactgtaatagaattttatctcagataaaactttcctttgtagagtatttttatacattaaatgtggtgtaatataatttaaaatatttgtaaatgcctaatggattgactttatttttcttttggtctacttatattattttggagagcataacaactttcagattgcttgaaaattaacctggtttctcaaaaaatgttattttctaattttggtttctgcacaagttgagtggtaatgaacctaagacatcaactttaagtaaaacactgtattattacattctttccttttccctttttcattaaagaatggcagacatacagaaaacatttggcccaatgagctataacaaagtattcatactatgaaatcaacactcatttcagaagaaagaatcttgtcagcacccaggtaccccgcttccagccccacttaatcactatcgccttactgttctccaaagatagcttctgactaataagactgtagaatagttttgtctgtttttagaatctacataaacggaatcatgaagtatgcatttttgtatcggattttttttttttttccctagagacagggtcttgctctgttgcccagcctgttctcggactcctggtctcaaacgatcctccctgctcagcctcccagagtactgggattacaggcatgagccatcatgcctggcccagattccttttgttcaaaattttttgtgagctgtgtcaatattcttgcatgtagcaataatttattttcattgtactgtagaattctattgaatgaatgcccccaaaatatacatatttattctattgttgaatacttgggttgtttccagttttgtgttattactgatagttctcctatgcatgttttcaaatttattagacattctttttcttttttctctttgagacagcgtttcgctcttgttgcccaggctggagtgcaatggtgcgatctcggctccccgcaacctctgcctcccaggttcaagtgattatcctgcctcagcctcccaagtagctgagattacaggagcctgccaccatgctccgctaattttttgtatttttaatagaggccatgttggccaggctggtcgtgaactcctgacctcaggtgattcacccacttcagcctcccaaagtgctggaattgcaggcatgagacactgtgcctggcccagaattgaattatgctatatacggtgttctgccacttccttttatcttggacaactttttctttccacatagtatagtgccaacacattcttttcagcacttgcatagtaaccctttgcataaaacacaatttatttgtctcattgttggaactttgggtaatgtttccaatgttttttaaaaaagaatgctacagaaacattattctacgtgtagttttgtatattcctgggaatatttttctaagatatttccagaatgaaattgctagccaagaggtatatatatattttttacagattattgatatttccaagttgccctataaattatatagtataaattactatggtaatttataatcttagaaacatgaataagaatgtctgcttttgcatattctccctagtactattatcagtctttcaaatatgtttggattttgtatttccaaataaaattattactgaaaaaataatataaatgaagcatagctgtgtgctaaagagatcataaaacataacatttggtatttccctatagactaaattttgctattttatataaaaatatttcagttatttttggatttgtaaaaacatttcagttaatttaagtggatcctaagttaaactcccctgctttcatcgttatttttagtattacagcttttcaatggataaagatttaaatctatattctggcacgtagtagatacgtaattttggaaaatttactcagttcctcttactttgtgtgccttcattttccgaagtcatgaaaatagatatggaagttaagtttgctatatcgctctcatctgattgttttccaggtttgatttagggaattaggctacttaggcaggtgcctgtttctcactgacctatttatgaccctctcaaagctgcttgttcttcagtgagaagagtttctagacatgtaaaggggcctgtttcctatgaataatctacaaagtagtctcttctgctagttagaaatggaaagaagtgacgtgaataatatttccttctttccttcatttatattgttggtgagaggagggagagagagagaacagaaatgcagatctaccatgtggtagacgttgcattggggctagagatacagtaatgattaagtgagactttctcttgccttcaagagtcttctaaactaagtgtgtaaaatagataaaaaggtagttcaaaactgcaaatgggtgccaacatgctaggggaattgttctatgcagaggacaaataaagacctggaggcaaagaacagcatgactggttcaaataacaaaaagaaataaagaaatatggtatagtataaattatacagtagcaagacaaatggctgaagagcagaaaaagaaagtttctttaaagtgttgaagtatgtgtcttattctcggagcaatggtttaaagaaaggcagtgatttaatcagatttcataattattttttaggatttaacaaagtaaaagacactagctatgaaagggctgtaatttcaaaaatgttaaaataagtctagatttgaaacagcatatctagatcattcttgataagaaaagaaattttgaaaaattggcaggcctatactctccaaattatcttttaataagatctagtagtaattttattattgacttcatcttgctgttaggtatcttatgaaaactccctttgagtagttaagaaaagataattaaacatagagtcatattttttcatcttcatctttttcacagcttctttgatttcacagcttctttcttgattttggctaagacacatatattttaaaagccataaaaattcacggatgtcctagacttaggattttatccctagctatggcttagaatactaccttgcttatttttataaacacgtatggtttcctgtttgtatacaatcatatctgttatgggggtataagaaatagtcatttacaatatgactaaatcactaaggaaaagatgtacagtaaaacttggattttggagatattttaaactgatggtttctataaaatgctattccctggaacttctcatgcctcacatcaccaggctgagaatttttttgtcttatttatttttacaatggtaaagtgattagttgtaaagaggaaaaattgccattgctactgacctaaatgattgttagtcatactgaaatgtgctcagagaatcattgctcaacatgtgaaaagcttatccttgcaataaaaatccctctattttctgatactctgataacattatatattgagaagtcacaaagatttactgatatatagcaagtgtaatttcttctttgtttcctctttactttctgtctctttttagtgccttcattgttcagggaagtgtcatgccaaggtatattgacaatactggtcctttttgagcatccaaaaacagtggtatttctcgaagctaatgattgcctattatttgtttcattagggaattaaaatttgtcagccttttctccaggattttgtttcatccagagaatattttccttcccaattgcttgcagttgacaccactatttgaatcctgatgaattatttctgcttcatgtttgccatagaccttctgctcagcttgcgtatgcttatatactttacttatcataaacttccttgtgtttgagatggggtaagcgttgttgatgatgggtagtaatagagaattattccatctacatcagatcacagttttttttttcaatgtttaataataggttttagaattctgggcaaaagtaacatctcttttttttttattatactttaagttttagggtacatgtgcacattgtgcaggttagttacatatgtatacatgtgacatgctggtgcgctgcacccactaactcgtcatctagcattaggtatatctcccatgttgtgttagtccattcctgcattgctataacaaaatacctgagactgggtaatttataaagaaaagaggtttaattgacccacggttctgcaggctgtacaggaagcataatgcaggcattgcttctgaggagacctcaggtagcttctaatcatggtggaaggtaaagagggagcaggtatctcacatggcaggagcaggatcaagagagagtggcggggaggtgctgcatgctttaacaaccagatcggtcaaaagaactcactcactgtcttgagacagcagcaaggtgttggtgctaaaccattcatgagaaatctaccccaggatccaatcatctcccaccaggccacacctccaacattgggtattaagatttgacatgagatttgggtggcaacagagatccaaactatatcatttgatgctttatatatatatatatagatatatagatatttttattatactttaagttctagggtacatgtgcacaatgtgcaggtttgttacatatgtatacatgtgccatgttggtgtgctgcacccattaactcgtcatttacattaggtatatctcctaatgctttccctcccccctcccctgatgctttaaccagagagaaatctttgcctgtgtcttcactgtatatctggtaaacatctgctcatttctcaaggttcctccatgccatttttcaggaaggttctcctggcctgacttctcccaggcagatcgacacctccctcctacgttcctagtgtatcttgtataaacttctcacatagcctctttaacacttcattatccatacttatgtccatgtctccctttctttactagattgtaagagtggagaatatgtcttttcaatttttattttgaatcttcaatgcctagaacactgcctcaaacttataggacccctcaaaacacagtaatgttttggatgtttttaagtaaacaaagagaatattttagaaatgttcttttgtaataatatttcatattctgaaaatcccagaggaaggttgtctatttattagcagatgcccacactacttcttccatattggtagatatgatcatgataatatatgtgctgtataactgatacattataaggcactggctgttctcaatatttacagttcataagaattacctgagattgttaaaaaggaggaatcctgactctcatccctacagactccggcttagtagatctgatatgggacccaggaatctgcatttctaacagtgtctctgttgcttctaagagcacattccagaaacaaaaattttgatcaacctagatggagttaatgcttgtgcttcaacaaaacatacatataaagacgtgcgcgcgcgcgcttgcgcacacacacacacacacacacacacacacacacacacacacacccctgctcagattaagactatagaattgcttttaaatacctcaaggatcaccacaatgccagagccatcaccattacttctttctcttactctgttcattgcttttctccttttcctctttcatttcttttctttttctttttttttttttttttttttttttttttttttttttttgagacggagtctcgctccatcgcccaggctggagtgcagtggtgcaatctcagctcactacaagctccgcctcctgggttcgcgccattctcctgcctcagcctcccgagtagctgggactacaggcgcctgccaccacacccggctaattgttttttgtattttttagtagagacggggtttcactgtgttagccaggatggtctcgatctcctgacctcatgatctgcccgcctcggcctcccaaagggctgggattacaggcttcctctttcatttctattatctttcttcttttctaacaaaggatggctctttacaaacattgctagccaatctgagcatccctttcctttcatgttaaatactaatttatttcagtgcacaaaatgttctaatctactgtgcttgtccagatattttttttgatgactgataatgagtgactgatttgtctctaaaggaagtgtttcattgtgagatgaagaggaaaatatgaggaataaaaaatactttgaagtcttcagtttcttgggtggccattggaaagatggtttctatattgctaattttaaagtaagatatttttagtcaaccaaattctcaatgtggctgcaaaatgaagcataatttatgtacaaactaagagcaaaggccacttgctgtaatttttacataactgttatcaaaaattgatgcattattttataatattaactcttccaatgactttttagtcctagatacttttctcaaatagaaattatattatgatccagaattttgaatataatttgaagttacattttcttccatttgttaaattttacattaaagagaacttatggtatattactcatactatgctttcattttggaagtcaaaattgtaccactaagactctctattaacatttcttaattaactattgggtttctggcaagctatgagcataccttgtagcttttgtgggtttagttccagaccactgcaataaagccagtatttcaataaagagagtcacacacattttttgatatttcaatgcttataaaagtgatgtttacactgtactgtagtctattaagtgtgcaatagcattatgtctaagaaaatgtacactccttaattaaaaaatactttgttacgaaaaatgctactaattgtctgagccttcagccagccataatctctttttgctgggagagggtcttgcctagatgctgatttctgaagactgatttagggtggtggttgccaaaggttggggtggctgtggcaatttctaaaaagatgacactgaggtttgtgagatcagttgactcatctgtagcatgcaattctgttttatagccttttacccacagtagaacttctttcaaaattggaattgatctctcaaatcttgctactgctttattcactgaatttatgtagtattctgagtccttacttgccatttcaacaatgttcacagcatcttcaagaggaggagattctatctcaagaaccactttcatccataagaagcaactcctcttctgtaacagttttatcatgagattatagcaattcagtcaaatattcgagctccacttctaattctatttttcttgctatttctaccacttttgcatttattttctccactgaaatattgaactcctcaaattcaacttcttccaaactcctgttaatactgatacttcgatttgacttcctcccaaatgtactcaatgacatctaaaatagtaaattcttttcaaaagatttttaactgattttttcccagatccatcagaggaattagtatctatgcagctaaaatcttatgaaaggtatttcctaaataaaaaaaacttgaaagtcagaattactccttgattcatggctgcagaatggatgttatgttagcagtcatgaaaataacagcagtctcttcatacatctcccccagtgctcttgggtgaccaggtgcattgtcaatgagcagtaatattttgaaaagattgttttttttctgagcagtcggtctcaacagtgggcttaaaatatttagtaaaccatgctgtaaacagatatgctacatccagactttgttgttctatttacagagcacaggcagagtagagttagcgtaattcttaagtgccctagaattttcagaatgctaaatgagtattggcttcagattaaagtcagaagctacattagctactaacaagaaagtcaacctgtcttgaaattttgaacccaggtgttgacttctcctttttagctctgaaagtcctagatggcatctttttccagtataaggctgtttcgtttacgttgaaattatgttgtttagtgtagccaccttcatcagtgagcttagctagatcttctgaataacttgttgcagcttttacatcaccacatcctgcttcacttcacatttttatgttatggagatgacttctttccttaaacctcatgaaccaacctctgctagcttccagctcttcttttagcattcatacaatggaagagagtcagggccttgctctggcttaggctttggcttaagggaatgttgtggctggtttgacttctatcaaggctactcaaactttctccattatcagcaataagtctgattgtctttcttatttgtgtgtacactaaagtagtactgttacattttttcaagaatttttcctttatattcacaacttagctatttcgccaggagccccaggttttttcttagctttccacatagcttccttactaatcttaataatttttagcttttgatttaaagtgagagatgtgggactcttcctttcaattgaacacttggaggccattttatttgacttttttcccagaaccatcagaggaatcactatggcagctaaaatcttatgaaatcttatgaatcttagaggccattgtagggttatctgaactaatttcaatattgttgtctcaaggaatgggaaggcctgaggagagggagaaagatggaggaattagcccttggtggagcagtcagaacacctattgattaagtatcaattaaatcttacgtaggtgcagttcatggcaccccaaaacaattacaatagtaaaatcaaagatcgccaatcacagatcaccataacacatataataataatgaaaaagtttgaaatattgtgagaattaccaaacgatgacacagagataagaagtgagctcatgctgttggaaaaatgatgccagtagacttacttgacacacggttgccacaaaacttcaatttgtaaacaaatgtaatgtctgtgaagtgcaataaagtgaagtccaataaaatgaggtatagctgtactgataaatttccactgaatatggaaatctaatatctgatctaaggtggtagatatgaatatagtgactggtattcatttaagatattttttgagtacagacttgtaaaacaatgttacaactgtttttacaaatattatttattcatattgtcctctatttctaaaaagaatactgcaaaaccaaggaatttcttatgggttcttgcaaatatacaggtagagacaatcttgctgttctcaacaattattttatctttttagatttcatagtgtaactcacacataagctagttatttctacttttgaattttaaattcagcctttttccacatgctttggaacctcttctagaagaagacactaatacttatattgctaaaaatatcactctgaggtgtaatatcttagttaaattcggcttcacctcagcatcactatttctacagctatcctttaaacctgtcagagagaggaatctcttctctttcatatttctaatccctctactggtgctgtggatctcaactttccacaacatgaagggaaattttctcttgtgctcagaagtttctactccagaaatttcagtctttccctgtcaattctagaattctcctgccttcaaacttttgggttatgtttctctactaacttttctagctatgtttttctttcatttttctcttcccttttcagaattactggtctgtagtttcaaaatctcttccacccaatttattgtagagaaaaagtaaagccaattttggtcaagtcttctttctcctcttgggttctgggttatatcccttcacatttttagggacctcactgtattcattatcacttcttccttgtatcctaaaccttaccctctctattgacttcctgatgtcaggatttatgcttggctaactctctttatcttaaaaacaatgcagaagaaattaaacaaacgaaaactctccttaaacttttgcacccccaactaatgaccacagtcatttctccttcttctcttttgtagccaaatttctttctttctttgtttcttctcctcctcctcctcctcctcttcctactcttccaccttttcttctttttttaagagacaggatcttgctctgtcttccatgctggagtgcagtggtataattaatagctcaccataacctcaaactcctgagctcaagtgatcctcccatctcagcttcccaagtagctggcactacaggcacttgccattatggctagcctgttatttttctttgtagagaagaggtcttgctatgtttgctatgttttccaagctgttctctaactcctggcctgaagtgattgtcttgtctcagtttcccaaagtgttggtattacaggagtgagccaatgtgcccagccccaaatttctttaaacattcatctatgcttacttcacggttctttgccttgaattcactctatacctctgaaatctgctttttattattttattaaagctgcactttactaggtcactaaaatatccttatttcataaattctatgaatacttttcagatgttatcttactagacctttcatcactaattaacactgttcaatttttcttcttggaaaaaacttttgatagtttggatttgtttttcagcaaattttcatttatcttctattcctactgtgatagagcatactgccatgtcagttgatgttgtgctaggccatatgattttctgtgaccaatgtaatagtagtggataggaactaagtagaggtttcaaatgtgtatctgctattttattttattttattttatttttttacttaaagactagtgtgatagtaatgcttggttcttatactctgtcatctgccttgagaagcacatatgctaggaacctgctgatccaaggtggatgtggagagatctgagcagagttgaactcaatacaaagcttagagcaagcccaaccaaccccatagcctaacgtgtaactggcccagtcaaactgtggacctatgagcaagaaaaaaataaatgcctgttgtaatttgggaatgtttattttgcagcattatcagacaatagctgattgatataactcaattcctagaaatttaataaaaccatcttctggatttttcttttaaatttcaggaaccattgtaatatgctatcgtttggatgtttgttccccaaaacctcattttgaaatttaattcccaatgttggtggtgtagcctaatggaaaatattagggtcatcagggaggatccctcatgaacggcttgctgtcatcctgcaggtaatcgggggatgtgagttatttcttaattcccatgagagctggttgttaaaaaaaagtctggcacttcccttagcactcttgcttgtattgctataaaggaataccagaggctgtgtaatgtataaagaaaagaggtttatttggctcatggttctgcaaactgtgcaagaaaaacaccactagcttctgctcctgctcaggacattatttttgcattcatttcaaaaccaagtacattccattaaaaagtttttaaatgaactgagccttttattttgaatcctatatcatggcttttttttttttactgctttctcaaaaatataattgaagtgatttatgtcatctagaggagtattttttctccctcaagtcatggattgatatagttcatgggaatagttacagggatttattgagcagaaatttaaataaacttgatgttggacaaaatcaatactgtcatactgaggagcattttatcatggttgttatcatacttgtttatattatactaaataaagtatatatatatatatttaaatgcagaataaacttactcagtgatttctgtttctttatgctaataacctattgattatttggaatattatcatgggttgatttttctatttatatagaatgacataacacatataaatgccccccacacaccataaaaaacatttgactaatgaaagtgctagagaagttggctgtagatgtaatatttttaaggtcctatcatgttaaaaatatgccataaggcataggaaaagaaagtcagtatttagggagaatgaaggaactctatatgttcccaatacaataaacaaaaaagtaaatgaaatgtccaatccaaaacccctgtgcattattactatgagaaccactgaaaaatagagtcatatgtcttttccacatttagtgctttggtcaaatctattgtttaatgacagaatcatacctttttcccctgtattatgaaattacgctcttctctatttctcactgctaagaggaacaggattaggtcaagtgacctccctggtgggtaactgggattctgccgatcactggaaagatcttattttattctttgactatctatgtggtgtgagatgggaatgattaccagctgttttattttttgtttgtgttattcagaaaatagcattctctacttaaagaacttacaattggaatttgacttagcatcttgtctgtttgaaaattcttcacagatagacacatattaaagatttttggattttcaaaaagcagattttcactttaaacattaataaactcaagaaagtcaagcagtttgggcacttcatgaagaaaagtggaacagtatgtgtgtttctggaatcaatgggttgctggatagtaactgtaaatcttacacaaatgatcccatattactgaataatagcaccttcccccatctctccaacataggcatgattaaaatgttgattatttgtgaagttacgttatccatctttattggaaaatgaaaagatacagtagcatgtctaatcctttattatcaagatgctcttatgttttatatcttcacagaaatagaggttgagatcaatattatatattatttgctttaagaagtgacatgttgaatcagctttcctgcaggctttcatttattcagccttgaactgattaccttgtaagatgtcagggttgtcaaaaatgctatttaacatgaattttttttatagaaatgaagcaactaaaatgcaagattatatttcagtgagctaaaagtgactatatcatatgaatattctgcagcttctgaaactttgggattttgtactatccagttcccgagggattcttactgcctcaggacctgctgaaacaaaatatgcctttgatatttaactctatgctctgtatgtgatccactcaaaaatagactgaaagtcttttgtttcttaaaaaagaggtaaatattgactttagacaagaacttcaagtcctcatggtcattctgcagtggattgaaaaattctctgtgaaagaaaactattttgtaagcatttttgtagaaaaattaaaaaatggatgtagaaagacatgcgataagaaaatctaataccatggattaagaactgaatttcgtttgttttagatttcctctaagcccatgattgttaagcataaatgtacattgaatatcactggaattgcttgttaaaacagattccttgaccccgctatcgaaaagtctaattcattaggtctggagtggggcctgataatttgcattttaacaagctctcaggtgatggtggtactgcttttttgagagcctcctttgggtaccactgccctaagtagtaactttagtgccaacacttctctgttaactggtaactcttatctcagaaaatgataatgatgccaagagtattaatgggagaaaagaacaaaacagattcgtttatgcataggatagccgcattagcaggattttttttgccttcatttaacattactaattttttttattaattggtgcaaaagtaaccgcatgaacttttgcatgaacttgatattaaaaaacaactaaatagtcttccagggcttgatttgattccccttgtgttggagaaaatattgacattcctgttgcttttaagcaataaatctgttagggtctcaagtttttattacaatcaagcctttgggagagccagtggaacagatctgaagctttttcattaactgatttcaaatctcttataatttagcagtcagaggagttgatgtaatttgccatcacaaatcactagtaaatgcacccttgagattaagaatcaaattccacagatatctgtaatattttaaaagtcaggatggtagagtgactcacaacctagttgaatgttaaaatcacctgggtaactttaacaatactgatctgatgcctggacaccaccattcagacattcagagttagttagtttgggcttgcatcttgacatagggagatggatagaggataatagttaaggagggagaggtgcagatatgaagacaactaccatttcttgagacctactttctttatgtcaggcactacagagggcattctaaaaatactatctctaagcctcacataaactcaaaaggtaactttaaaaaaaatctaaggaaagaagcttgaaaaaaaggataaacttttccatggcaagagattgttaagtaatgagggactggccccagcatccttgcaagggtactagatgcttccattccttctctctctctctgtgtctctctctctccttttcttcttcccttccttccctccctcctcctttccttcctctctctccctttcttcctcctctctcctttccctcccttcctttcctccttccccttcctcctcttctcctcctcccttttcttctttcttcttcctcttttttctcctccttctccttctcctcctttattcttccacaaatctaaataccttgggacaagagacaacctctaacaaatgttgaaagtcccatgtaaggaggaatgtatccttcaaaatatacacttgataaagctttgcctacaccacctgggtgttggacatgggcaattacaaatgtatctagagactgagacactagctgcatttccaagtatatctgaaactcattggcttagccttcaatgaaaagggcattggaagatacatagatagtttagattgagaatttggcaacaattattactgtaattgtagttgaaaaccatctgtgatctcattacgtagttacagggacaagatgagggtaaacctctgatactaagaataaatgaaccatatcagagagaacaccagaaattctttcttctctgatgttaaggaacccatgtagaaatcagtctacttaaaaacagataaatataacctgctcccatgtatattaacaacactttaaagctaacaattacaaagctcttttagatgtgttttataatcttatttaatcttcacaacatctttttagagcaatggggaaagagaaaataatggtttatatattaatagatgtgtacaaagtcttttgtacatatttttatgtaaccctcacagctagccaaaagtgttattttttttctgttttataagaaaggctcagaaaagtgaaataacttgcacatagtcattgattcagtaactactggagactgagatcaaaacctgaacccagtacaagcaaaaagttgactaaaattactactctcactctctttaacagtcatttgtattaagctgaaacacagttgaacctctgtatagaagctgttgttttacctaaatgtatatataaataagaaaatcaatacaggacattcattaacctaaaattataaataataaatccattaaactcaactaaaatgaacactgagctacttttcacataaagggctttgaagaatgtcatagggtatagttattatattcttgatatgcattggatttccgacctaaaaatttttttcttcctttcagttccaaagtacattcttatttaaacttcagctacccatccaaattggtatttaaaataagtgaatttgtgctcattcacctggtgtcaatatttgtaaatataaaatcattttcagatgaacttcatttattttatttcaagtcagtttcttgaaggagccttatgacatcatgaggaaagtcatttcacagttttatgtagaaatatagttttgtttttctagcattggttaagttgaagctttagaattgcgggcaccactggataaaattgctcctgtaaacatgggacacctggtggattacttcagcaaaatagggccttgttgaaaagtaattgtgcccatgaattctcacaaaactaggttcatcatctttaggtctatattaatcagctttagtgagctttgaagttactaagaaaatgagacttttttgtaaataggttatatattttgtctttaaagaagaaagattctaaattttaattgaatgacttaaaagtagattaagttttaattttttctcagtgttttatttatgttttcacatggaattgggtctatttagtttcttttatctcatctgacggatatctctttcttaaagtaatgtgcattctcatttgaaaccaagaacatgctgaataattgtaaggatatttcctgaggttcatgaaaggttttttgttttgttttgttttgagacagaatcttgctctgtcgccaggctggagtgcaatggcgcaattttggctcactgcaacctccacctcccaggttcaagcgattctcctgcctcagcctcctgagtagctgggactacaggcacgtgctaccatgcccggctaatttttttttttcttttttgtattttactagagatggggtttcgccgtgttggccaggatggtctcgatctcctgacctcataatccgcccgcctgggcctcccaaagtgctgggattacaggcgtgagccatcattcccagtgtttttcagtgccttctccgataaggaacccgagaggcttccagtcaacactgggggctgggttcagtgaattcagtcatgctggtagagcccactatttttgtcctagtgggcaaaaaaggaagcctctaggggcaatgactaaagtgttctaaaacccatcatgttgcagcagtacaactaaatagagtcctcacatggcactgtgaggtagactactatcccctatttaaagatgaagaaactgaggtcaagtgaggttacaagtttagagtcaataagtgatagggctgggattctgagtcacatctgatggacgtcacacctgcccttcaaaactttctctcaccctactgttatctttatttgaaaaggcctttgtgtgcatttctgggccctggctattcatatgatgaatatctgggatttttttttttcccattagagaacattttccaaagatgcccttagaaggatggtttcatcacattttctttcccctcaccttggatgtttggaggggttgatttttttttaacagaggctatttgagatcagcattatttggttacctgcatgttattacggttcaaaactttttaaacactgaacaactgaagttaatcatttacttatttgtcccttgaacaagtgttgcccattcagttagaaataatgtgctcaatatggaaaaattaacagttgctgagtcatcaaaggaaataatgcaatttatggatattctttttttataatattagagtttgctaaataaatcagtaatatatgaacacaatgggaagatgaattaatagttactttgatttaagattgaggataattgtattttcggagtatggtatttatggaggctttatatataggcctaatcatttagacatcataaacttctttaagctcaaaaattgctgtataatttctaagctttttataagcaaattctaattagttgtccttcttaacctgatgatcgatcgggcttataaaagagttactaaatgtcacaactgaaagaaaagaagcagtagcttttatgaaaaaagagaatctatctttgaatcaagactgaaaccttaactatattccatgtgtaattgtgaaacttaaattatcttatcgtgctttgagatcaataagatatatcatccttatttgcttagtatattcttgcatggttcaaatgaaatacataacatgcttgctacataactgtagatcttagacaacgaagcaaatatttattatttaccatgtgtcagtaccatgcaaagttaaaagagtagagtttgttaaaagatttatcttggtccgaatagttcgacattcatcaatgtggctttctgtttttttttcttttgagacggagtctcgctctattgcccaggctggagtgcagtggcgcgatcacggctcactgcaagctccgcctcctgggttcaagcaattctcctgtctcagccttctaagtagctgggattacaggcgcatgcaccacgcccggttaatttttttttttttttttttttgtatttttagtagagatggggttttaccatgttggtcagcctggtcttgaactcctgacctcgtgctctgcctgccttggcctcccaaagtgctgggattacaggcatgagccaccgcgccaagcctaatgtggctttcttagacttgtctactcatgactagtctaagaattagactatttgtttttattttcacctatatttatctctaaaatatgttagaatcaaaagagtaagttttgaaaaacatatttattggtactaatttggtctcttcggttctagtttttttcattgacttttaaagacttaattaagagtatgcttatttcattgttaaatactatagctagatcacaggataagtaacactcatctcaaaggggtgtgtgtgtgtgtgtgtatgtgtacacacacacgagtcatgcagtacaaccagtgaattaaggcacagagtcaaataccatttcgtttatgtgactgtttgttttgtgtttttgagaagtgaattgtatttgaaatgcaaagacaatacagtagatggataattgaatgatattttaaatctccttgaaagtttaataatcataacaattttttgtgtaattaaaatatattgtcaggccaggcgcggtggctcatgtctgtaatcccagtactttgggaagctaaggcgagtggatcacgaggtcaggagatcaagaccatcctggccaacatggtgaaaccctgtctctactaaaaatacaaaaatattagctgggcgtggcagtgcatgcctgtaatcctagctactcgggaggctgaggcaggggaatccctcgaaccagggagttggaggttgcagtgagctgagatcgcaccactgcactccagcctatttgtaacagaggaagactctgtctcaaaaaaacaaaaaaagagaaatatatatatatatgtgtatatatgttataacatatatacacatatatttatacatatatgtagtcagattgtttaaactgaaatccagctatgaatgtgtaaaatataaagtgaaatatgttttttctcatttaagaaaacaaatgcattagttgaatctctctctcctctttcggaatcccaggcatcacacttatctagacatctcacttatcagaattatgtttcacacagtgatacttacataaaggatataatgcattccatctccgtcctctttcatagcaatctcatgtgccagtttgtcatgtttcttatcacattctctgccccaaaatggcaaagtagctacatggatgatgactataaaaataggcaggaccacctccttttttttatattgaacctttttttctaggttttaaggttctttatgtcatataaaggtctctaaaaacatcaacttattttccctgccaaagagaaatgccaaagaaaaatttgactttgattctcaatctcaaaacttaatatattcatttttataatttatcatgaaggatgctgtctgctgaattgggacatcttacattaattattattattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctatgtctatgtgttttcattgttcaattcccatctatgagtgagaacatgcagtgtttggttttttgtccttgcgatagtttactgagaatgacgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttggtttgagccgtggggaacaacaggcttctctccatcagctaacaaacaccttgtaggggagctaagcagggacaaaagaagtacaggtccacatttccttccttataatatggaaattcaaactaaacatgcagtgtctgtggctcatttggtgacaaaaatttgatcttgacctgaactcacttgttaggataacctgttctgaactggtttaaggcaatttgtatcttatctattccacttggtgtgaatattcacaatattcagtttttgctgaagaaatatggatgtctttgattatatgttgttattccaaacatgtatatacacacatatacacaagtttctaaaaattataaaaaatacctaggtccaaaacatatctggccctatgagctttggaaaagtggttgtaaggtctctattagatattgtccatgtcttcaagccacttgtagtttattgagattcgtgacagtaaactccactctcaaacagagagtcaaaatagttattgaaagtctaacagttggccgatatatacatatacatacatacgtacacacacatgcacgcacacactatccatgttttatatatattatatatagtatggattttgtggtacaggagaaaagtagtgttaatgtagaataagtctagtaatgtaaaatatttcagagagtaatagaactggttctttctttactaagtgtatttgaatttatttcttaataaaataaagcaaaaccacagccagtaagaaaacctctgcatatatgctgaaggaaaatgtatataaggcagtaaaattttcatgagagccctccaacaaatgcattttttttcctatgtaaaggaaaggtgttttgaagatagagttgtgtaatcagtttagagcaaagaactaaatagaatttattggctttcactctcgccttactagatctgactttaggcaagttacttaaaatctctcagcctgctttattgtctatgaaatattaataataaaagtagccgccatagagagctgttagaggatgacatgggatagtgcatgtactggcgggagcctggcacagaggaggtaggccgacttcgctccttatctggaagctgttccatccaggcctaacagatgatgtttttagactgtggaattccacataattaattcttagctattcaggatcattattttcattgcatattagatttccctttgctgggctaaattgttccataatcttttaagatttcatctctaataactaaagtagttgtctggtgaagaagccaacctcagctgctttacgctttcagttttattaacccgaaagcctccaagatgactctcatgagacttccagattgaaccttcagaatttttccagagagtggaggaaactggaactaagtggaatatggctatataaatgttcatctgagtgatttttgagctttgaaagaatatatactttattatccctgatttgttttttaaagtgttttatgaaacacttgatgtgttattcatggacttagaggtgactgaaacttttatagctgttattcattccaggcatgaagtgatcacaccttttgccctattaggattgtaccacagtaagcaataagttacaaaaacaggggatatatggcaatgggtgatattcacaactagaaactccaacatatttctgctagatatagtgaagtcatactagtttgaaggaactactgatgtgaccaagaatctctgcatgtgtttaaatggtttatctaaaaggtaagtggaagagacggtagcagggcctcattatgactttcatggaccctagacacttctaactgcctgggcctctccttccaatagaaagagaaagagaattataaattataaaggagaagcagagacagagagagttacaaattatattctgccttggtataaagactggattcattattatatattcattattttatatatactattccttgtatgttgaggctggattcattattatatattcattatctttatattttttcatttctaatttaaagacaaattagaacatttttgaacctctaaatgtaacatgtaccctaggcactgtgccttctgtgcctgcctaatgtgtaagtcggtcccggatactaggagaagtttgctaatcctttctcttaaaagccagttatggtcagattctgccatattctgggaacaaagagagggcaccactgcaatccctggatttctacaggagtgtctttcaggcatagagtagaggcttggctcatccaactactgatttcttcaacagagaaaaagaaaactcagcttcaatataggctgatagatcctgtcttgacttccaacacaacttaatttctgtctgccactatcctaggctattggatctcctgactagcaaaataaaaataaaagaacttaaaattatttcattctcctttcatttgtgctagaaatattttgaaatagatacataagttttttggaagaacctatctcaatactcagtattgaaaatgcacagactgtcctccgtgatcatgagcaaacagaagaacacttactttggttcaaaagatagtaatatttaaaataagacagtatagatttatacattgtttactacaacacacgataaaggatttttgaatttattatgctggtatcgaaaataaaccaaggacatgcttttccaattaaggtagaataagaatcatggatgagaaaatactctgaaacaatgagagattgtgtggaatgaaaagcactattgctacatttaaaacctgaaagaaaatagagatcattgatggaattttaccaaatcagccatgtagatgacaagttcaggaaattctcctggaactcagaaaaatataaagagaccaaaattacaaaagacaaatgacatgtgaccaagaaagacttgttccacttaccttgactaaatttgcttcttcctaagtctcaggcccgttacctcccttttctatgggatttaccttagaaaacttgtaattgggccaggtgtggtggctcatgcctgtaatcccagcactttgggaggccaaggccggtggatcacctgaggttgggagttcgagaccagcctgaccaacatggagaaaccctgtctctgctaaagatacaaaattagcagggtgtggtggtgcatgcctgtaattccagctactcaggaggctgaggcaggagaatcacttgaacctgagaggcagaggttgcggtgagccgagatcacaccattgcactccagcctgggcaacaaaagtgaaactctgtctcaaaaaaaaaaaaaaaaaaaaaaggaaagaaaaaaaaagaaaatttgtaatgggaaattttttctctttttctctatccctttgagatgtacataaatcttttcccagcccagcctctagccagttttacaatccaggaatgtctttctcaaggacctgggagccatccctttgaaatataatcattaaggaagatagtgcccctacccctatctcttagtttctataggagagtagaatctaatttcaacaagtgccaattagcaaacacagttgacctaatcacgagtctcaccataacatccttcagtacatgtccaactagctcacctcagctcttaaaatctctctcacttattgttttggtggagttgagtctaatccctttccactattgcaatagtcttgagtaaagtttttctttcctggttaaatttggctggtacaatatttctttgacacaaggaggccagaactctgagattacataggcgtttagtaggcattcaattaaaaaaaaaaacagcaaacaagagaagcaataatttaaaatagtgaggaaaaaaatgtttcatgagttcaaggaagtcttgagtcagcatttgtgtagtaataactgatgagaagacatcaatacacaggtatggtaaaatatctaacatttcaagaaaaataaaacctttgtttaatgactagggagggggaaagaatgtggcaaacagaagaaaataaattttacccactccagaattagaatataactattctttattattgctgatgtggtaaaaagtaacacaaatattaaaatattttaggaaaattaacatgttaaaacaattcagaaactatgttctggtttaaaatagtacatatgaagaaatttgataaaaaggatgtattagttcattctcacactactatgaagaagtaccacacactgggtaatttataaaggaaagaggtttcattgactcacagttctgcatggctggcaagacctcaggaaacttacaatcattgtggaagacaaaggagaagcaggcaccttcttcacagggtggcaggatggactgagtgcaagcaggggaaatgccaggtgcttatacaaccatcagatctcctgagactcactcactatccccagaaaagtgtgggggaaaccaccaccatgatccgattacctccacctgttcccacccttgacacatggggattatagggattacaattggaagtgagatttgggtggggaggcagagccaaaccatgttaagggataattcaacaattcttttctttttatattaataatatcaataaaagatgtgaaatttatttcaagttttaaaaaactctgttggaatagaaatagaatgtttgccttcaaaatcagtagacaaactaataaaggaaaatgaattaaaataagttagccatcacaattttcataatgtatattttctctaaaatacttatgtttaaaattctcatgttttttattagaatttaaacattataataaaattaattatgaaaaatctaaataaaattaaataaaaaattctaatctgatttttaatctaaaaagtcttttattattagaatttaaaaattctaataataaaattatttctttaaaatacttcctcatgttcttttttattataataattaaaaatttctaataataaaaaagaacatgaggaaatatttttaaaatgcgtgatacactataataaatgtgatgattacacttcttcaaggacagtgtcaaaaaaggaaaaacaatacaaaaatcaaagactctaagattggggcaaaaaaaaattccggatatatgctatttacaagagaaaagtttaaaagtttttagtcattatgtttaaaatgacataaagctgtaaataaaatgagaagaatgtcaggcaaatataatagcaaatgaaaagcagaaatactcaacagaattcaaagcaaagaggatacatggaatgtagaggattcgttttataaatggtaagaaaatgtacatcacagattaaaaaaaaaaagaatggtcctgaatgagccagaaaatgtacatgcaaattttaagaacactattataaatacaaggagattcaaatgataaataatataaacatattggatttaagtgatagaactaataagattaacttacatactaaacttgtaacttatttagaaaaaacactttattttcaaatttccatgtagccaaacaaaatcaatcctatattaggccatagacaaattgttgaaaaattctaaaaagcaaaaactacgcatgctacaccctttgtctataaaatacatataggatatttattaaaaatcctaacataaaaatatgcactgaatttgataggccttcccagatgcaagtgatttattaaggaaatatacttaggacaaatctgtaagtaagggaaatagaataatgcatttgagtgggatgagagactgaagtctagtctcagtcactcccagtgtaaacacacatccaaatgaccctgtagaggtgtccgccctcaggcagagcagcagggcttggctggtgtgtcatgcccagagtaaagcagatcttcttaggccaggacagtttcccagagaagagtgcagctatgtggtcacagtagctgggagacattcatactgattagtaaaaaaggattccgggttgaggactgacatcaacaacagccatgctttcaattaacattaattttagcagctagaaggagaaaacataatgaaagtagtataagtaagaaaaggctttgtttttttcatgaaacaggaagtccagaggcaggcagtttagatctgtgcattaactccaggacattcttaagtatctctgctttttctccctgcctgtcccgctccatagtatcctaagcgtgtggtttcattctcatgttgaagatgactgctaagcctttgggcaagtgaccatatccaggcaggaacaaggggaagggtagaggacctaaaaaaaggcaactagtagtaagctctgtaagacttcttccagagctctcctggaaatactacctagcgacttctgttaatatctcactgggtagaactagaccctacttgtaaggacttggcaaaaatgttggctatccacattctataggaaaggaaggcagatgagaagtgggatttggaatggctctaaacaccaacaatgtttaccaaatcaaaccattttacatttgagataaatgactctcttaattaactcttaggaaaatagtcacttttacaattttatcatgcttagaaaataacagagattaaaaagtacatataaaatgatgcacaagcgtcctcctcctcctctttccgggtgagtgctcccccagtaggcaggcagcatggtggccaaggagacaggtggctggagtccccaggtcaatctctattgtcctacctgcatcaactgggcatccaaggcttgtaattctgctcacagaatatttcaaagaaaattgagctgctcacaaattattacataagaaagcaaaagatgaaaaggaaaagcaagaagtgtctttctggactgtagaaggtgatattaacactgacccgtgggccagtgttaatatccatacactggtaaacttaggccacattatccactgatgacaacaagactggtgccaagttataggcaaagatgattttactgatcattccttgggaatgtctgaatctgaacaggctcttaaagatacttctcaagttaaatttttctgatctgaagatcaaaagggatgcgacttgtatctaagctgctagagaagtgttgaatattgctgctgggctggttaagccaggtgtaactgctgaaggaacagaccatgctgtacacttagaatgcattgcaagaaattgttatccttctcctctgaattattatactttcccacagaattccagacagtccttggaagaaggtgatattgttaatgtcgacatcactctttattgcattggttatgatggggacatgattaagacatattttattggcagtgtggatgaggatgcacggaaatttgttcagaccacgtatgagtgcctcatgcaagccatcaatgcagtgaaacctggtgtttgatacagagaattgggaaacatatttcagaagcctgcccaagcaaatgaattttcagttgtttgaagctattgcgagcatggagtccacaaactttttcatacagctcccaatgcactccattgtgcctaaaataaagcagttggtgtgatacaatcaagccatgtatttacagttgagccaatgatttgtgaaggtggatggcaggatgaatcctagccagaaggttggactgcagtgaggagacagctcggttccactattccttgctggtcacagacactggctgtgaaatgctaacctggcaacttgatagtgaatagcctcactacatatcccaactttaatttcttccaaaatagcacatctcaatagtaccttcttactgtactatgcatttttgggggagtagagaaaggaaggggacattttttatcatttgttttgttttgaccaaaggtaagaaaggactatagcaatttcatatgtgtcctcaagaacttgttttgagtctaaaaaagctgagaagattaaaggaaacattgctcaactcctttcagtgctgtcccctccctctaaatctttctacacacccattttctcattatcaggctttttaaagtttagattatggcaaaagtagccatgctcccagtggtggctgactgttgcagggcatgagaattttgtagtacactgctatgccaaaccgctagttggtcagaaatgggaggggcaaagccccttttcttctcttctttattttatttcaagggcataccttggagattctcagagaagggtggacggtgcactgtggaggatgatggggaaagagttctaaagtgtctccagctgtgagcacagtgagtcaagtgtgctgttagattctgtttagtaaacctgatggtgactatagcagggatgtaactgtccatggtatcctgaaaacacacctcacctttacatagttgagaacctcattagaaatgacctcagttgcccaatatctatgttccttttgacagttgtccaaataggaatgtatccaatgactacacatcagatcctaaagtcattgtcattattagagtggacttaattaatgggtatttgctaactttcatgtaatataatttcataccactgacatgttatatcatagttgtaagagaatatcttttccagagtgtctgaggccttattgttttaaaatagttataataacatttccattgcttttattattttattgatttagtaaagtgactatatctggtttcaatttgggggagtatgtgtgtgaagttttcatcaatctgtaatatttgtgatggaatgccttgcaatgtaaacgttaatataatgtgtagaatgagatgtaaaagtttaaatgactatcaaaaaagatattatgcaacgggcatagtaaagcctgaaaataagtaaactaacaattaaacaaactaagcattagaaaaaaagagtaaaaatatatacttgaggagagtaaagaagaaaaaagtcaccaaaaacaaaagtttaaatttaaaaattgggataaaaatgggaaatgccatttttaatttaatatttgttctttgacaaggtcattaaaatagaccaatccttggcaagacatataggaaaacaaaggagaaaagaaatgtataatgttagaaatggtggtgggagggatataacaacatattttgggtgttttttcccttaacaataaagcaaatactatgacaattctatattttttaaagaggccaaacaggaatgaattacaaactttttagtaaaccataaatgactaaaattgatttgacagataatataaaaccatggggaaaatggataaagcaaccgttaattttcaaaacaccattggtcaaattgaaatggaaacaacagtctgagcaaaaaatcctcagcacaatttaaaaatataaatttcaaaagttttttaaaatgtacatattctttagatattttgctcgcagggatttttattggggaaagaatgaaaagatatacataaagattgatgtgaccaagtatgcaatataccatagtttattagcactacttgttatagaaagtattgataataatttcagtattcaactgcagaaaattaatatattccatacaatggaatatattaattaggttgaactgtatcaaattgccactattgaccatttctaatcaacaaaaacagtgaattcaaacctaataaatacacacaaatacatatttaaatatcccagtaatttaactgtggttatctctgactggggctcttttgggtgatttaaacagtctaattagattctaatacaggaacaaaataagcacataacatgcatgtattactttataatatttcactaaattatgaactcttggggaacaggcatttggttttggtaatcattacattcttggtgcagaaggaaatctgaaaatatttgttgaatcaatgactgaaaaaatatttgtactataaaataggaaatgttaaattgcaaatgagaaaagctagagaaattgctcattaaaccatttgcctcaccgtatggaagggtcagagcaattttaagcctatagtgcttaatttaggcagtaatttttctgcaaagtattcagtatgtatagtatctgataatgttatgtctattttctagctatctttgaaaacatcttattaaatttcataaatttaacatgtggagaactaaggaaaattccaatgataaatggggacattcaacattaagagaacattcccgcataaaagtttggaacagaactgcagcataatattttaatttatcataatgatttatgaaattacatcaaatacattttactgtctcattatccaaaattctcaaatttcaaaaatgaaatatttgaagatgtcaaataattatgtagaccatgctgacagtctgccaggaaaccttcattgcagaattgtagttgagttgttttctcctctagtgcatagaggggaatgagaaaccactaactgtgatggtctttaatgtcatgcaaaagaacattgaaatccatatttgctcagaaatcctattagtgtctctattgaggaaacctcaaagaaaagcactgaagtgttaatgatttgcctacagaattttttgtccaaatgtttggataagctgacaggaattaattctataaaaatcctttctttcaaattatttcactaatataaaactccctaatccagtagcattctttgacatttttcttaatatcaaaatgctaattttgcctacataatattaataaatgaagcaggcattttttattactctctctccttactcatagggttggtgtatattttaattagctgcaaaagttacaactgccttgttatttttactagaaaatttattcttgtagtcacctaatggatatgataatcagtacggagcctagaagcttctgcattctgtttataaaagagacacagttcctgggtatgaatttgggctctgagtggagacaggtaaaccaggagagaatatttataaacacagtaagtagatgtatttggttataatattttgttggctgatgttacacttgatttgcagttttcaaaatacaaaatacagtgcccttaaaatacaatgttgcctcctaacgaaaagcttataaacctgaataaggctatattttttttgcttattttttttggtcacaaacaaatagcttaaaaatgatggctgaaatacgcattctagatgtggattccttatgttaaaagtcagattttttttcataaattaaaatatattcagtggcaaaatttgacagcacaatgtggggttcatatttttactatcaagctattattctcaaaagtgttcaggtaaggaggtcttcctgccctcccccttcccctgccagaggaagaggtacaagagatttttggcatcatgagataaagaaaggcagcaggcttaaaaagcaactaaaggacttgattgtgaggaattctttattcccagtagtgtttgttcaacgttgaactaggaagggattgcagaatatttccaatttgataaaaaaaagtatataatacattctaaatattttatatttaaaaagaataaatattctttcttgtctttttacatttatctctactgccacacagctccatttaatggaatttagaaagtttgtctctgaaagagtacagtcttcaattgatcctcacgtttgtcaagaacactgatgcttgatttgattgcagctccagcagttaaaggagtgttcatttcatgatcaagtagcctgaaaacacttctttaaaatgaatgtttcttttatatttggtgattcactgctcaccagggtctctgttcctgggttttccctgcaactctccttctgacatttccattaaactgtaaaaagtaagtgttgactgattaacatcttaagagctctgtaaaaagccatattcatgaatcaaagtcagtgtgccccactggtaattaacttgacaaaattcagctttccaagctaatcatcctctggctgctttatgtaattgctgtcaattcagatctacaaaacaattggagtccactaaaaggcagagagagcataagaactaatgattaggccaagttctctagctgagaacatattctgattaaaatgctggagtataatgaggaaacagaaacattcaaaatgttgacttgagggttccacatttataattatatgaaaacagcctatttaagatcaaactaatggtaagggttaagtggtgagattcaatgtaataaatatcctagggtttaccacataaaagttactgagcaagaccctgaaaaggcagtagacctttagggcacagcagggcatcgtggatgaagagcactgcttctgcactgagacatttaaatactggcctttggctagttgtgtgatttgggacaaactgctcagcttcattcagcccacattttctcattaggaaaatagaaaaaatgattttacttagcttatacatttaaggattaatgcaaataatgacttaatctgttacccggaatttcgtagatgacaaataactatcacatattctattatcattacaatttatcactaagggaaaagtcaagtatgcaaattaatataacataataagcatgctaagaaaaatacagatgaaattgcccattgtatttacaaatggagaaccaacatctgggtcaggaaaccttgaaggaagagaaattgattttggaggtgttttctcacaagaagtataatttatcaactaagttgagaagatttatttcagtaaagttagagcaaagtcattcatcaggaaaagcatgatgtgcaacagaggaacagtaaaacaatcattttactaggcatacgattttatgatagtgtaaaagaagattatactgcaaagaagggttggataactattgtgggttgactatttaaatcatcattgttgaatgtttcaaaggatattttgttcattccttaaagaccagaatatttcaataccaaagagttccacagaaccaaaacaggctttctctccccataaactctcagtagacatatattcaataattaaagctatgtatactttcttagattaaaatgactagcttttatggaagtcaatttagtactcttatttagaagtgacaagaaacttcaaacaatgtaagaagattcctcaaaatacacatttggtacacacaaagaaagaaacgtaactagaatattttaaatattattaaaagcctatatttgtttggctaaggcaatgggcgtcgttcccacggaaaaatcacctatagagtttatcaaattaaacatctcttgggctgagtcttaaaaattctgatttcatttgtttagagtgaagctcaaagcatcagtaattttcaaagatataagggaatcctaactgtgagaaaggagaccaaagatacttcctctttctctcctctgaaatcatgtaaacaagaataacaagaaaaatgtaaaccatgtttttgacaaaaatagggatatctataatcttgaatcacaatttaagatgaagagctgtcaaatgcaataaatatcaaatcagcgtgcaggaagatactgacagagggcatatgcagttacatatctcagacacagccagccaaatgcaaacattttccagaacattgggggatgctaaagaggaaaatctacagtcctcggtttgagtcaatagaaacaacatgtttgagctggctgtagaaactctcctgtccaccatttgttactaaagagaggtgggggaggtaggtctcattgaggaaatcacattgcttgccatctttgctggaagagacatgtggaataagcagaggagaaaacatctattgtgattaccctgcagctgtctcagaaagatggggcaagacatgctggcctcatacaaacatccaatccccagggtaagctgaaggaaaaggcagcactctgtgagccagggccagtttctcttaaatagaccactattcggacacacacagacacacatacagaatcaatcaatcaaacatgagcacttggaagtgtaaaaggtatataaattataatgaagatctggcagtcattaatacataggcacaagtaaaatggacagaaatatagtaatacaatattctaatttatataggatattctaatttatctctcagaccacggcaaacaaatagaccaaaagtaatgcatagatcttaataatataagtataagatatggtttaagaagctcttgcaatattcacatgagaaaaaaaataatagattagaaagaaatcgctaacatatttcccaaaggaaaagaattagcttcactgatcacagtgaaataagtggctctcacaagtggcttttgggttaaagatgaagttcagagcaaaagagcagattacttggaaagtaaatataataaagcattatatatgaagacctatggtatacaatttagtcacagtaactagagacaagttcctagccacaaccacttgcattgataaagaatgaaaataaataatttcggtaactaactcacacataataaaataagttaaacaaatgaaaatatttaataatttaaagcagaaagtaatgtcttagagaacagacaaaacagagctaataaatcaacccaataactgggtcttaaacaaacaaacaaaggaaaaacaatggctaacctaatcaggacgctgatggtgaaagcacaaatacattaagaattggaaatgggaaaatatctcaaaggcagaagacattaaaagaattgcataaggttagttttttcaacattataaaaataaattttaaatcctacacgaaatcagtatttttctaggaaaatagaaatgagtgaaactgatccttgagaacacagaccaattgctaaagaaaaaaattcaaaaactttatcatggagatattcccccttccaaatcagtataaatccagattgattggtggattttatatataaattttttatcttcaaatagtttgaagcactacaagaaacagatgcttgtagcacttcaagctatttgaaaagataggaaaataaatatttacacttgtattagtcagggttctctagagggacagaactaataggatatatatgtgtgtgtgtgtgtgtgtgtatatacacatatacatgggagtgtgtgtgtgtgtgtgtatatatgtgtgtgtgtatatatatatatatatatatatgagtttattaagtattaatttacatgatagcaaggtcccacagtaggctgtctgcaagctgaggagcaaggagagccagtctgagtcccaaaactgaagaacctggagtccgatgttcaaggacaggaagcattcagcatgggagaaagacgtaggctgggaggctaggccagtctctcctttcacttttttctgcctgctttatattcgccggcagctgagtagattgcacccaccagattaagggtgggtttgccttccccagtccactgactcaaatgttaatctactttggcagcaacctcacagacacacccaggattaatactttgtatctttcaatccaatcaagttgacactcagtattaaccatcacacaattatattttctaatctagcattacattactaccaaaatctgacaaattaaaaagatatatagacaatagaacttgaaacaaagatcaaaataaaagactagcaactagaatgaaacatcacaaataaagagtaatataccaccactaagtgtggcttactctaggaactctaatatggttctgtattgaggcatcatattaagagatcataagagaaaaatcaaatatttaaatacatagagactgaaattatttgcataattcagcatatattctgtatttttagaaacttttaataagatagtaataggcttgtgtattcttaataaataatctataaatcccaaagtgattttgaagaacaagtgaaggggaactgctgtatcacataccaaatttagcataatttcataataatatgatatttgttcagagtgtacaatgttgaacaaaacatagagctcggaaacttatattgatgtcattatatggatacaccaactagtgcgggaaaagaaaactattccacaaatggcactgggaaaattgctgttttattttgggagatggggcagaaatttttacttcatactaataaaatcaagtccattagaattttgaagggtaaaaaaaatttaatctttagaaaaacaatttatgaaaatatgtgggtgacttttgtgttgtgaagcatttcttaaacaaattacagaaagcaaaagggaaagattaaaaatgtaaagcttcattttgacaaaggacatcattaaatacagtttgaagtcaagccataaactagcgaaagtaatatacaagacctacaattgaaaaggaaccacaaacaagatataaaaattttataactcagtaactgagagataaatgacccgttaataaagggtcaaatattgtgaacaggcatatcagagaagagaaaatctcaatagtcaataaatacatgaaatgaggctccatggcactaacagtcaaagaaatgcaaaataaaactacagagatttaatgttttgtgtctaccaaatttgcaaaaattaaaaagcatagcagtggagagttgtacctgtagtcgatgggattttgaactagtaaaagcactctggagctcaatctggcaatatttagtaccatagaagattcataggttcacagaagattcatagattcaacctagcaacttcacttctaaaaatatatgctggagaagaacagtggttcttaaccttgggtgcacatgacagtcataccagtacccaggctgcactacaaaccagttaaatcagaaataccagagacatttttctggcatcagtatgttataaagctcctcaggggattctagtgtgcagtggagcttaagaacccatgtaggagactctctcacaaatacctaagaaaaatgagaagaaatctatgagcatattaattttaatcttgtttgtagtaatgaaaaactgcatttcaaatgagtaaaaaacttggatagtcaataaggataaatctcaaaatctcagcatttagtttaaaaagctagttgcagaatgaaacatattgtaccatttatataagatttgaaggcatgcaaaacaatcctctaaaatgttcttgatcacataatgtgcagcgttttgaaatgtgtaagaatgattaaaaaacaatttcaggatatttctagacctcaggcataaggatgtcagatttagcaaataaaaatacattcaaattgtatatcatatgagacatacttatactaaatatttattcattgtttatctgaaattcaaacttaacagggagtcttgcattttatatggcaatcccacttgggaggggatctggaaaggtaaacagaggcttcagccatatctgtaatgttttatttctttaagaaataattgaaacaagtatggtcaaatgctagagtttgacagaggttgtttactacaggggtaacttatatttttctgtgtccttgaaatactattataaacatattttaaggaaaatacaaggaaagaacagacctcagttgtagtaacaatacaaaggagaaaccatattgaaataaacattagtaaatgtccaagatcaataagaagaaaacatattacactaccaaggattagaaaggaggatatgaatagacagacatgccatatcttgcttttggattgttagactttacagtgtaaagaaatctgagcttcctctgttagtccatacattcaataaattcccctcaaaaattcaacataaattcttatgaactacacaaaataatggattctaaactcataagggtaaataaattcacaagatctgccagataaatctgagtgatgaaaaataaagggtagataactcaaccttgtaatgaaacatgttataaatctactgtaattaaaacagaggagtatgtaaataatcatagttacatttgagctgaagttgtgacctttgatttggatggctatagaagtaaaattgtgtcaatcattgcaaaatgcagatttaccccagtatattttaaaatctatgccatcctccttatctttttactttttgccccaattcagatttatgtcacctttcttctggaaattatagtaactctaactgctgttcatacttacagtattttcttcttcaagtttctcctaaaaccttagccaaaatgattgatcataaacacaaaatgtgtcaactccttacataaaatagtttaatgcctcttcattgcatccttggcaaatgtcaggcatggtaacatggaataaaagacaatttagggcccagccttggcctccctcttcagcctcatctctagcactgaaataactctgagagcttcctcttgtcccctcctgatatggttttattgtgtccccacccaaatctcatcttgaattgtagcttccataatccccacatgctgtgggagggacccagtgggaggtaattgaattatgggggtgggttttcccatgttgttctcgtgatactgaataagtctcacaagatttgatggttttataaagggcagttcccctgcacacactctcttgcctgccgccatgtaagatgtgcttttgctcttcctttgccttccaccctgattgtgaggcctccccagccatgtggaactgtgaagtcattatacctctttttccttatcaattattcagtcttgggtatttcttcttagcagtatgaaaatggactaatacccctcctatacacctggccatttctcactgcctggaacttttacctttttgcactcatttcctagcatcctatatatataattgatggttagtaaatgaagtgacctatggaatatccactgaagtcttttcaataaacaattgcatacatgcccaaacaattgatatttaaaatagacaaaaaacaataaacttcctgggatagcaagctggacagatatttctagttttattgactatgtccttacactggtttatttacttcactttaaatcagctttaataaatctgttttttgatatcagttaaatgtagaagaatcaaaccataatccgtatttcttcattttacaatggtggttccaagaaaaactctaatgaggaagcttccctcatctttttgatccatccctttttcttcctatatatgctctataaattatcatacaccacaaaaagaaataaaagtgataaactaaaacaatgggtttaattagaaataatctgatcatttaactttaattacaaggctattggtgtatttaaatttcattttaaatgacatctattgagcaactatttgcaccggatattataaatatcaacttaatacttgaaatagtatgtgcattaggcattaattctattttacagatgatgaaatgtgacattgagttaccactagtaaatgccaaatctcagagaagtagacattatatcatttcacttcagacttattttccttgatacaagtatttatcctatttttacttatcttttgtgatggatatttacaaataacaactattattagatgaaataaattttaatggaaaatttttgaaaattctagaaatgaattcataatgtattatcatttctaattgaatacatttgaacttgctattatgtttttttattttttctttgagaagcagaatttattttcctttctttccctctttactgtagggggaaaaagtctaagctttcaaaacttccaagagttttgtatatatattctgaagaaatgagacaaaactccttctatttataatagggctttttctcaagtcagacaaactgacccaataatatcacattacagtgggattttggcctaaagtacttaaaatataacccgtgtaacctagccacaactgaatgaagccaataatgctctcctactgttcaatgataaaaagaacttcaggaaagtttcatttatcctgctctttcactgttcagcaaggtgactgccaagttgagtttacaatagcttaaatgggctaaaactaaaagcatttggtagagtggtatttcaccatagtagttcttgtgctcaacagctgaactgaatttacacgaaaagggaaggaggaaaatggtttgtctttttttgcagagaattctatccaaattcacttgcatttaattacttcatattttggaaatgacattttcaagtgagtaaagtttgtctttgctgcttttcaactctttcatctttcttctttaagtgtatatttttaatttaattttttttttttctgtgagacagagtttcagtctgttgcccaggctagagtgccatggtgtgatcatagctcactgcagcctcaaacttctggactcaagcaatcttccctaatttctatatcttgtcttctctcatgtcctttgacttctattcctagagacctgtcagcctttgctattaattctcttataaggccttataagcaatcagttttcagtccttaaaaagtgattcatggtgctatgataattttcctcctcaatcattaatcaaatatgccaggcactgagtgaagcattagcatatggtggatgagcaactaatattggatgagacaatgatacaataatgagtaagacccaatccctactctggatgagattattattaagtaagcaagatggaatagccagtaattaaattctgttaccttacagtaggtaatgagttaaatatatgaaaactgtattatgggaatgcggcgagcaggacaaattattctgcaggttgaggccgggggaatgggaggcttcattaaagaagaaatgtctgagtcttgttgtgaaggatgtctagggagaataattgggacagttttctaaccagttgaggtattcacaagcaatggggttgggcaaggaccagttgtgtcctgagtctttctattgagtttggaacgaacacaaggtgtggggcgggagtgacaagtgataaacttggacagttagacttgctctagacattcaaggactttctttgtgatgctattgagtttgaatgtaatcatgtgggcaatgcaagacaaaataattttaaaaaaaattgcaatgagtgacatagaggcagggagattgttggaatagttaaggttgccagctctgccacatactagctgtgttatgaaattacttatctttttgtacatcagttttgtcaacaatatggtgctaatacatatgactggtgtaaagattaaattaggtaacaaaggctaagtatttagaatgggtgtttaggaaaaaacaaaacatgtttcttggccacataaatgtcttcttttgagaagtgtttgtttatgtcctttgcccactttgtaatgggttgttttgttttttttcttgtaaatttttttaagctccttgtagattctggatattagatagattgcaaaaatattctcccattttgtaggttgtctgtttgctttaatgatagtttgttttgctgtgcagagttctttagtttaattaagtcccatttattaatttttgctttggttgcaattgcttttgatgttttcatcatgaaatctttgcctgtgcctatgtcctgaatggtattgcctagattttcttctagggttgttacagttttgggtttcacatatatgccatggaacactacgcagccatgaaaaagaatgggatcatgtcctttgcagggacatggatggagccagaagccattatcctcagcaaactaacacagcaacagaaaaccaaacaccacatgttttcacttataagtggaagctgaacaatgagaacacatggacacaaggaggggaacaatacacactggggcctgtcagtagcaggggtagagggagggaaagcatcaggttaaatagcaaatgcatgtgggacttaatacctaggcgatgggttgataggtgcagcaaaccaccatgacacacatttacctatgtaacaaacttgcacgtcctgcacatgtatcctggaactttaaattaaattaaataaaaaaaaaataaaagaacaaaacaaaacacggagatgaatgcatgaagggaatgagggtggaaaagatccatcaatttcagtagatttctggaatggaatagcctgcatttgggaactggtgtgttgtgatgggaaaggtagagaaagaagtgaaatttgcgctgaggttttctagcatggtagcataaaatgctacagagggccacaggtgattgaaggaattcctgttaacatttttgtacaaaagatgctacaaatctttgcaagaaactgctgtatctttcagttgatattagaatacataggactgaaacttagaatagaagtagtagttagaaaagaaatatttgggaactaagggcgtaaaagacagctgttaaaggcattcaggttgaacgtgtggattaaaaggtggaaagaattgtttgttacagcagtttttaaggatgaccagaggagaaattgctaatgatagattcatagatatattgggaagggagatcttttggtgcaagaacttctcatggaggcgtttaacacctatgttacatatcaggaaaataaaattactgttttggagaacatttggaaaaataatcatatttattttatgtgtttattttcagccctttgtttcctaaacaaatgtttccttacatgtttgtgattggactgtagcaatgtataatctgcttcattcacttaatatttgatgcgatccatattgtcacataatcttcataatcaccgtatttagcagctataaaaagcccatattgaattgcaccaaatttccttgactatttcccaactgggagatatgttaacattttcttcattttgttctgccaaatatcttcagaactaaaatgactttatcagtttctcatttttccttatgttgatgaagagtcaaactctgtaaaatatttgaagagatttattgtgagccaaatatgagtgaccatggcttatgacacaaccctcaggagatgctgagaacatgtgcccaaggtgctcggcccacagctaagttttatacattttagggggccatgagacatcagtcaatacatgtaagatgtacattggttctgtctggaaaggtgggataactggaagggggccaggtttccagcttataggtgaatttaaagatgtcctgattggcagttggttgaaagagtttatctaaagatctggaattaacagaaagaaaatgtctgggttaagataagggattatggagaacaaggttcttactatacaaattaagcctccaggtggcaggcttcagagagaatagaatgtgaatgtttcttatcagacttaaaaaggtgccagcctcttagtcaattctctcctggatcagggaaaaggcctggaaaagggcaagggaattctctacagaatgtagtattttccccacagaagacaactttgcagggctattttaagatatggcaaagaaacatattcggggttaaaatattttgatttctttccttatctgtcatgtgatgttatgccagagtcaggttggaaagtaaggtatgttgtatagggttaaataaaacccctctgatgagactttgtggtttgtagggagtgactccctggtcccttggataggaatttgggcaagagaaggaaaaaaatcaaagtttagttctcacgtaggtagtcctatttatgaaactggatataaatcacaaaatgtctattccacagaattgatatttactttaacagtaaaacatattcaactttccaacaattattgatgcaacaacttaattattggtggcattctcacttgcattattgtcattttccatcaaggtacaggtattggcatcaaatgctcctttttaaaaaagaccaaatattagcagtcttactactaccaaattatacttaactgttaaaacattttaaggtatcaaaatctgcttcaaataatcttggctattccaatacttattaacgagcttgattctgtatttattattcactaaagaatcaaccatataagccattatcatatatgaatacattattggcagcaaatctataagggtctgcagcaatctcaattcttgcctccttagaagaaagaatttgactgaggggcataaggcagaaaaagagaccaaggtaagtttaagagcaggagtaaaagtttatttaaaagctttagagcaggaacaaaaggaaggaaagtactttggaagaggcccaataggtaacttgaaggaaaagtgtggggtttgatcttttgagttggggttttatatattggcatacttccaaggtcttgcatcccgtttcccttgatttttcccttggggtggaccgcctacatgcacggtggtctgctaacacttgggagatgagtatgcgcagtgtgcttactggaggtgtaggcacgttcacatgaagcattcttcccttttccggtggaatgcccgcggaaggtcatataccagttaaactctgccattttgcctctgaagtgtgcatgcttgagcccactcacccagttcctgaggtcttatcaggaaactgtcaatcaccaggttcaggtgtttttatctattaggaaattgcctttccctgatgctggctgtaaccaattattactttagagaggcagtgtgacaactgcctggccatcacctgatggttgcctgacattcctggtggggtacggggagccctctcctgccccactcctacctgactatctactgtaacaaatatagcctagacacattacatctaatggagataattaatctgataacatagatcaatgtgaaaactcattctgtctctatcatttagtttccagttgggaaattcatgtttttgtttgtctcactgggtgcatagtttacaaatgaagtaattatcatacatggcatttctatctcgctttttcaaaccagttgaattttgtacatattataatagtattccaatattttgtgaagggatgtgtgtgtgtgtgtgtgtgtgtgtgttagtgactattttagataaggtggtcagagaaggtatcttcagagaagcaagccgtgcaaagacatgggagaagaattatagacaaaaaaagatgataaaatacaacatgccaggagcctagtgagcaaaagccaagtgataaattccagagcacaagtgatgaggtggctggcctggtgcacagtgatgcatgatgcttttgccttgtgttctaagtatgtggacccactagtggattttaagtggagctgttacctaatactatttgcacttttaaaatatcagtttggctgctggatggagaatagcttgcagaggggagaggaagtaaggaatctagtcaggaagatattgttgtaaattaacagaataaataataacacacggagtggtaagaaaaattagccatattaatgtcgatggacttgactgtgatttgatgccaaaaaaaagtgtttcttaataggaagttgagatacaaataaagacaagtacattacaagcaacaaaaaactactttggtaacaaaggcttcaatttgcatgacttctttctcagcaatcagtagtctgagttgagtgaaatggtgtattcatgaaaggagagtattagatactaaattagatctctgtgcaggcagagagacccacattgtggagggcataaaatacgaagttcagaagtttgtacttcatcctgtaggcagtcgtattaaatgcaaatatttgaagaggaccatggaatgtacaatttggtgctttaggcagtggtttttagtatgttttgagggaataagagtgcacacaagaagacttactggggaataaaataatagatgggatataaatgaatatctgagcagaagccaggttcattgttaactgttaggtgagagacattggaagggactgtctgtagggttgaagaaggtagaatgaagggtaactccattttatttacataaaaattcatcattaatccctgcaacaaactcgtgaggtaggtaagattcttttacagaagaggaaactgagatggccatggcatagtagcttgctaaattctcacaaatagtgagggacagagtgggatttctaagccctggtaaattatataacacagtctcaaaatctgctgaaataattaaaactttctaaagattgattgtgcacacttattgtacatattctcagaatatttatttccttgctgaaatagttgttgtacttgaaaactgttgtgcttatttacattgttgttgctaagctatttaaaacacaatgtaaaatcaaaactttatttaaatagaactttggcttttatcctcagtgtattcatttaatcacaaaaagtaatgttaatgtgtttgttcctaaagtcttttgtattgctgttttgttaaatctatttgcttactgatttaattaatgatttgtctatgacagacctaattggagattactatgcttaaaaaaatgggataaagtcaaagaaataaagctgtagaaacaatttagtggaagagaaaatgctttgacaataagcagtagtctaaaaattttaagtgcgatatatattttttatctatgttttcttgctaagttaaaattaaaatgtgctagacttgaaaacagacaaaacacccctgaggttcttttacctggttttataccacagtattctttgatattagtgaattatttcagtttgcttctttgcattgttataggaatgattaacctggtgttctcctgatttattagtgctatctgaaaagcaccaatactttattatctccctggaattctttttcattttgtaagaatcattgagagactgagctatataatacttgtatagagctgtgtcttcttaaagatttaaggttaatcattataaattaatagtcattgatttcacatagtggaccagtcattgtagcaaactgaatgtacagtaaacagcctatacctctattgtccacctttcagttaacacaccacaattcactgatttctttgactgaaaaaatatttctttttttatccttatgcttagtcctgcacaggagtgtacagatattgtgatgtatgttagtactacttgagacgtctttcaaatgaacaaaataagacttcctctgggtaaataagagccagaatataagtataattcaatattttttttgttaataacctggtaggactagggtgaggtcataaagaaaatgaggaactatctatacaatggtaatagtagtagttacatatgtggttttgttttttgtgttttgtttttttattttttttttcatttaatccttgaaaccactcaggcaaccagcttatttataatcatgccattttcatggataatagaaaataaagttctgataggttaagtaacatgaccaaaatcacagagtttacatttcatgaaaagtaaatctatatgtcgtggcaataggtgttgtgcagggcttcagtgaagcggtgtgagggggagagcctggtgaaagagaagagttggagtctagggtgttagggatgaggtttttcactattttacgtatgtggttaggaagttctgactctcaagaaggaaggagtgatccactgtctcaaattctcctactagtccctataagatgagaactgaagtttggacctttaatttggtggtgtagaggtcactgaggctgtgaaaagagctatttcctggagtgttaagaagataagcctgattgaattggttcagaagaatgagaggaatggagacagtattaacagctcttaaatgttgctataaaggaaagcagaaaaatgggacagtaactggatgaggatgtgggatctaggaaggctgattgtcacttctaagatggaaagttttttaaaaatcaggtttgcatgatgatgagttcatctactagagaggaattatcaatgaggcaggaggggaatattctggagcattgcctctaagtagatataaaggtatggatgtgttctaatatatagggagggattcactgtaggtaaagtagggaagctcatgtattttaacagaagaaaagacatgatgcatgaatacagatgaaagttagttggtgggtgtggtgctggtgatatttgaaagttctcttttgattgcgttttttaaaaaagaattagaaagcatgggtattagctgtgcatggtggctcacacctgtaatctcagctctttgggaggctgaggccagaggatcgcttgaacccaggagtttaagaacagtctaggcaagatagtgagacccccatctctattttgaaaataaaaaataaaaaataaattaaaaagcatggacaccagttgagaatcagaaaagaggaaaaatgctactaagggaagagaaatgagacaactcaagaaaaggcactttggagaaaagaaaatatatttatcttgaggatcttatgtttgagatcctctggtcattcaagaagagaggatatctaatccttttgctcagtcaggagatgaagtctagagatagatttgggtatttatggcacagatatggtaatttaaaccatggtgtaaaatatatggccagggagaactagcagagtgagaagaagccaaggtcataacttgaagaatttcattatttgtttaaataatggaagaggagccagcacaggaggaagaaaacaaagatgggtaaagaaaagtaggatcaaacagcaatggcaatgacaaaatggacatttatagagtgttcagtttttaaatggaatctaataggatgaagaccaaaaagagaccactgcattttttaaagttaggaagttattgattatctaactgggaattatttcagaagagtgatgggtttgaaattacaatagtgttggctgcagatttgatatatttgactatgagagtgaaatgaaacatcctgggatgttaatagtttaaactgagtcagaggaagttttatgtttttataaaagttaactaagtatctcctgtgtgccagacactattcccagtagccttggacaaaatggacattgtggaaaacatatagacaaaaatttctatcctcaaatttcttacattctaggttaggttctttcttttagcctggaaattttgtatcaggagaaggagtcaaaggagagagagaaataaaggaggtgtctccagggcactgcagagctaagagaaattcacaaagtgtttagattacatcacaagaggaaaccatgagaaactgtaaaccaggcaaccctggttttcagtttatggcttttacatgaacaaggattttgtaaagaaacactataattcagtgaaaacaacaatatactagggtgtcagaagactgtggtatcagacccacagcattaccagttatatgagttaaggaaagaatcctgcagagccatagcttcttctctgctaagtagcgataacatctacctattgacctccaagtgttgttacattggtcagatgaaattatatggtctctaaagagcctcataaattaaagcgtttactataagaaggtgctaattgacaaagcacatcttcagaatcttgtgacccatattttgtggttctcaaattgaagccatttttattatcattatttattcgtatttatctgagttctactggagtgaatttttttcatcttcttgatgtttttattcttaaatttaaatttgtaaagtatttacaaaacattttattaagtttttttatgagccattaacaaaataaatttggaatatataattctccttgacaactgtgcactaacacagaaacaaaggctttattatgccctgtatggtcacgtgtttataatagatgagccttggcttacaatgactgctttgtttgatgtttattagcccatgccttggtgcaatttaacttgtcctaaattcactgtttcagaactacaacgtgtgtagcacattcattgtcctttgaataatactctgttgcttgagtagaatctcaagagactataaccttgggattttaaggttctttccttatatgctctagaaaacccttaatgaatgtcgattatgtaaaggcattaaaacattttaagtggtagaaactgtccttatatgattttgaaaaaatgtctgtttttaaaaaatatctacgtagaggatcgggcttacctcacattctccccttagtgctgatgttaatgaatgtgatccaggtgtcaacttcaactagtggttattttatccaacttcaaataagacaattctacggtatagtatattgtttataattctaatcttgattccaggaagtttccataattttgatgattattacttaatgttttacaatggtttcacaaaagttaaagacaaaaacattttaaacataacattttaaactctagaacactttctttttagatacccttgatttataaaaacagaatttgtttctccttattttcctcaatattactaaataaaacaaacgggtaattaaggtactaaggtaatgagattatctcattcaatcaatttatgttataattaaaactgaagtttaaaaatattctgtgactgcccaagctacatgattggaatgtagaacctagaatcccttcattaccagagtatatgtcattgcctttggtggttttcataattaaatatcttcacatatggtagtggtagttatggtgaggaaagagtggggttgaccacaatcctgccatgttaattttaccttgcaggggcctgcaaccatgtgaatactctgaagctctagtaattttgaccaattcccactaaaaggagtgaagagaggcaaaccttattcttccctcctcctcatctccttccttttcatcttcttcatcttcactatttgttgctttcttaactttctgaatatactgctataaaaaagaggaaaatgctgaagaaaattacaatgacctataactccatgactcagaaatagccactctctttattctcctatcttatcattatttttattagtcagttttcatactgctatgaagaaatacccaagactggataatttataaagaaaaaaagaggtttaatagactcacagttccacgtggctggggaggcctcacaatcatggcggaaggggaagcaaacacgtccttcttcacatggtggcagcaagaagaagtgccaagcaagaggggaaaagccccttataaaaccatgagatctcgtgagaactcactcactatccagagagcaacgtggacgtaactgctcccatgattcagttacctcccaataggtccctcctataacacgtggggattatgggaactacaattcaagatgagatttgggtggcgacatagccaaaccatatcattatttttctgatgcattttttgtaacagatattttagaaaattgagactatatatttcacactattttataacctgcacatagatttgacagtgtctggagcaacatcaaatatgcttacatgttcttcaatattatgaattttaattgttctataacattttaatataaggatatattataatttaattcatctcctattgttggaaatttatattgtttctattattcactgttatgaaaatcaaattttttaaactttgcttcatatcgttaaattaccttcagaaagttatcagttgatattccaccagtatgaaagccctcatgttcttctatgcttcacaatatttggtacactatagatgtgtgtgcatatacacatatataggataaattataatatatgtttaaataagttaaatacataagtcataatagtacctcattttttggttttgttttacattattatatattggcaaggctaaatacctttcatatactactggctatccctatagtcatcccttgtatctacagggaaattgatttcagcaccgttacaggtatcaaaattcacaatgttcaagtcccttttatgaaatgacatggtattttcatataaccaatgcacattctcctgcatactttaaatcatgtctacattacttacaattcctaatacaatgtaaatgctatgtaaatagttgttatactgtatttttttatttgtacttttttttactgttgcattgttttttaatggttttgaaaaatccttttttatccacagttgtttgaatctgtggatgtggaaagcgcatatacagagagcaactgtatcttcttttgcatttcttaatcatgcattgccaggtttttcttttgagcaatcatttctaacagttatttgtattttgatgatattttctctttttctagtatttatgttgcaagttttttctccagttgtcaatgttatgttcatagttttaaaaattaaatctacctgtattcttttttgctttatcacatctattattaggtccctttctgtacctctactctgtgaaaaagaactctatgccttctattagtaccattttcaatatcgttgttgctttataatatgtcctcatattttaaaactgatttctatacatttaaaaaaatttcttggttgaggctgggtgctgtaatcccggcactttgggaagccaaggtggaatatccctggagcccagtcatgatcagcctggacaacatagtgagactctgcctctacaaaacataaaaaagttagctgggcatggtggcatatgcctgtagtcccagttacttgagaggctgaggtgggaggattgcttgggcctaggaagttgaagctgcagtgaaccatgatttttccactgcattccatccagggcaacagagtgagaccccacctcaaaaaaaaaaaaaaaaaaaaaaaaaaaaaaaaaaaagaagaaaagaaaaagaaatggcttggttgttcttactatttatttatttattccagaaataaaaatactttttcattttcttatttcttatttatttattcttccaaagaaacttatctgggaaaagagaagtaatagcaagtttgtgtgttgataggaattaacaatgggtgttggaaaacattgatgatacaagaagaaaaagagctgggcaaggcgggtcacatgataatcctagtactttgggaggctaaggtgggaggattgcttggggccgggagtttgggatcagctagggaacatagtgagatcctctctctacaaaatatttaattaaaaaaaaacagctgggcttggtgttacaatcccaactacttgggaggtggaagcagaggataccttgagcctaggagtttgagattacagtgagctatgattgtaccagtgcatttaaacctcagtgacagagcgagaccctgtctctacaaaaattaaaaaggggagacttcctggagtgattagagtaggtgagagggataagatcttatgtataagggggaagttttgatcttgtagaatacagtcttgtagacccttattattatatggtacttgcctagtaagggtggaattgagggaagggatattaatagcttaaggagagaagagttaagtttgaaatactaatctagaagaatgggagcaatgaatggtttggttggttcaatttcaggagattgttcataaatgtaaagtgaaaacattctgtatgattatatggtgtgttttgtttttctagccacatttagatacatagttgcaagcacagaaaaggtgtaactgattttaactagggttggatccagtcaaggatacagtgaagcaggagaggagcaagggagttttatataatgaagtgatttttgtaatgtgtcatgaaatttaagccaaataaggaaaatagtaagagcatgagttgggggtgagggagcaggtagtaggatctatggattttaggtcttggtgtggtagaaccattggagttaaggaacttagagcgagtgatctgggaagaaagaaggccatagtcagagagtacagtgctagaaattgagattataaggggagtgtcctcattggtgtaaccataggagctgcagtggcatggatgacaaaattaccaaatgataggaagtcaataactaaaaggtcagtgtttcagaggagccatgtgtatagctattggaactgccaaaaattacaataaaattagcattggagattgtgacagtgggcaaagatgtctgagaaactagtaggtaattgcaacaagaagcagtactggatggtaccgtcaaaggccatgagtttcaaagctgagggttgttaggaaaggcatttgcactaggtgttccccgagcctagaatgctttcccctagatcttgcaaatagtttgctcctctttattaattagttctttgttcacatgtcacctccaagaggcttcgcgtcatcatccaatttgaagtagtccctcaagtcattctctgctttgttgcttgctttatattttaacagcacttataactaactgaaactatcttgtttatttatttgtttttatatactggacactccttcttaggggatatattttgaaaacagttttgctagtctttttgtgtggctagttcccagacttgtgattacagccacatagtaatcagtcaataattagtttttgattgaatgaatgaatatttataggatatcttggtcagcttgggctgcaataataaaattacatagactgagtggcttaaacaataatgcagttcctggtgagggctctcttcctgatttgcaaacgtcagccttcttgctgtaacctcatatggcaaagaaagagtgactctggtctctttctctccttctaagtatattaatcccatcatgggggttctactcctatgatctcatctaagtataattattttccaaaggccccacctcctaatgccatcacgttaggggtgagggtttcaatatttgagtttgggaaggacaaaactttcagtctatttcatagatgaaatattatcttccacattcctgtgacttctttcagaatccaaatatattttttaaagcatcctctagctcagagcattcattcttataagaattcctattattgaccctttcctcaagaaacatgaattaaaatataagaagaaataaagtataaaggtaaggcttgctctgtgatagttaagttttcaaagttaggactcacagatattgtcagttattacttcaagcaattctcaccagtgtgttaatgaacttgaagtacagttatcttttgatgtattggtttcagcttccactatgctgttttgctcagccaatgacaaccttccatagattttcaccacacaaggataaccttgttgctcccctcactatgacattctttcagaattctttgcacattcttttagaaaccagggtgagcatgaattgaaaatctcattggtaagaaaaaaataaaaccatttatctatcttaagttagtctttctttattaaaataatcaaatatctttatatttttgtgctaaatacaaagtactatagatttattttcttatggcttgacaataagcagacatattaggtaattaacatgctatttagtttatatatagaaaagtagaaatagcatggtatagtagaatgagcacttggtgttgtcgaggattaattaagataacaaatgtaaatctgtctccccttcttttctctttaatggactaaatatgtgttattcatcttcttacactttaatttggtgccttagagaaagaaattttttccacattgtagatagttattatctagtatgattctaattgttgctgccctatttttataaaatgccattctgtaatcacatcagtgatttaatgtttctaataatttacatttttaagcctctggtgttatgaatattttatacagtagttgatttctatttatatattcagaatatttgaagttcaaaacaaagtgttttttttttaatttgttggtgttctgagaattttataggagatttgaagagaaatatgtcaccattttaaattctgcaaccagttactgaacacctaccaactgaaagaccttggtctttttcgaagtaaaaattactgagacaataattgcaaaggttatttaatttcctgttacaatgtaattctttatatctgcttaaaaattgtgtcttctgtagattttgaaacatttatggacactccacattgtaatattttgcatcccagcaaactgtgtaatctgtttttgttttattttgtttttattatgaaaaacttcaaatatgtacaaaactagatgaaagagtataatgaactgctacacatacataatccagtttcaacagttatcaactcaagatgaatctgatttttttataccgcacccacttatatataacttacctctttgaacaaaagttctcaaaaaacaaatctgaaggaaagagactttattccagtgaagagtttgcaaaccaggggagacacagccttcttgtaatgaaagtacattccagacaatagagagaggattcaggttttatatatatatatatattcttttttttgtttgtttttgagatggagtttcactcttgttgcccaggctggagtgcaatggcccgacctcagctcactgcaacctcccactctggattcaagctattctcctgcctcggcctcccaagtagctgggattacaggcatgtatcaccatgcctggctaattttgtatttttagtagagatggaggtttcatcatgttggtcaggctagtctcaaactcctgaccttaagtgatccatttgcctcagcctcccaatgtgctggaattacaggcatgagccactgtgcctggtcaagtattcaggttttatagcaaaagttcctgctcagtttcccaataaggtttgtttatacaaatggaggattgaaacttgcttagttctgattggttgatagaactgagccctgattggctgggtcaagggagctctgattggttggtttccaagcccaaaaccagaggtctctgttaggtattttgtctttttctttttcctttttttctctttctttctccctcccctcccctccccttcttcccttcccttccctttccctttctctttctcttttttagacagggtctcactctgtcacctaggctggaatgcggtgaaatgcttatggcacactgcatcttctacctcccaggctcaagtgatcctcccacctgagcatcccaagtagctaggaccacaggcacccaccatcatacctggctaattttctgtattttttttgtagagatgtggtcttgctgtgttgcccaggctggtcttgaactcctgggctcaagaaatctgcccacctcggcctcccaaagtgctgggattacaggcgtgagccacctcacttggcccagatatttttttttttttttttttcaaaaagccactgtgggactggggagtgaatcaggcaacaacttatcttggcacctacaacaggaactgatttgactttattatagaaaggaagtcctgtgatacttttataacgtctttctgagaacacaagagtaggtgaccactcccttacccagctatggccaccaggttctgtcttaaatatagacatctcagttagccacgggggtccactttgcctgttggtcagggacatactttaataccttagatctggaatcaaccactcctccaagttctgattgccttagtattgcaagcccttaatctgggtgccaggggattttattgctaccaagctgggtttgttttggttttttgctttttttagttgacagtataggaaatatgttttgttttgattttgaatataaaatatattttcagttcatactggcttttacaatggaaatttaaggtttctgaatttttaattacttcttacatctgtacatccttcttccatgtgaagcatcccatgtgtcatgaaaacaagagatgactatatatcaaaattatatcacaaatttatatcacaaaattacacatttgttttatcctataaaaaacacacaagaatatctacaatacaaacactgctaccaacattattattattgacagcagttaatgtttttttttttgcagttcttttgcagttccttagattatagctcactaggcgtgtgcaaattattgtgttttaaaatcgcttggaactgctgttcgcagtgtggctataccagtgactggatacacatttggatctatttatttcatattattttgtgattttaaaagctttttattgaaaattggattttattttctaattacccaaaatatttacatggttcaatgaaaaaatacaaaacaaattatatttaagtaaatctagttgatagctcacaccctgaactctatttttttatccccttataggtgacaacttcaaaaaataaatagttcatacttacattgttggtctttcaaaataatgcacacacacacacacacacacttccactttgatatcataaaggccaaggatgtagtccatgttacctgtgttcccctaacttaatttaattttatatgatatgctccagaacactgaattgttcccttggaaaaaaattactctgtcaaataaaatttagaaaaatggatttgtcaaactaaataggttttctggaaatgtgcattataatcttcagagaagattatcatacatgtagcatttcacaaatgtatttcataggtaatctatttgtaaatcaacatgataaaatctctaagtgaaatacagtttggaaaatactgacttaattcatgtactatggagttgtcaacagatttatctaaagacttccaatttttaaatatttttcatctataccaatttttagaaaaacatactcagtaatttagtgtagtaacacttctttttagttagacaccatttaattttctcataaaatagtagtgggtatcttttaaaagcatcctagacttgggaaattataataagatttgttcttctaccaatcttcactggagcacttctgttctttaatctgcggtttccttttctttttcttgaaaagttttagtaaactatttttaaatatatgattcagtcagttttgattcctggttctcagtttggttgtggacatgtggcattaaaacatattttggttttattttatttcttagatagatcagcttaaatactttaaaaggtaaggtttttttaaaaatctactggttggtagctgttgcttgtatgagtatttatatttcagttattttacttgtattattttaaatttaacatttttttctccatagttagagggttttttgtttgcctgtctgttttactgttcacttggattttggggactgtttgtgtcttcagtgaacaatcatcaaaggctagaatcatagagaaattaaaatgttactttagaataggctaaacttctaagcttaattaaactttcaaattaatatcagaatcctaatttaagctgaatggcaatgcaggataactgatttctctgtttttgttagggacacttttacaatacaatcctaatttaagctgaatggcaatgcaggataactgatttctctgtttttgttagggacacttctacaatacacattgactagcacagacatcacaaggtctttacattccagactgtatacacttgttcctctttaattcacaatcagcctcaaatatattaatctctgggtaactacaagtaagtatatatttaaagaaagctagactttattttctttcaaaggaatagtaagtacaaacattatgaattttactgttacacatatacaaagatcacctctaatatagccatttacaagtacaatgtccaaagtagaaatagccttaaactaccacaagagggatttagggcaaacctttgacattttgtagaacaccttcatcagtgacgaactgctagatatactctttaactgtgagtaaaaatcatgatgataagacaaggaattggtccatggacaaatagaagtcatcaccttagaaaacagattaacatttaaatgttcttaagaattcagagaaatagtcagaacttatccaaaataacagtatatttaggcaaaaactttacaaaattttagataagtaatatgtactatcataaaaactgagcataagttcaaaacaaaaaaaagtaaacatctttatataatatatgaggataaacgttctactgcatagaatagtaaaagaaggaaaggacttgtgtcctagcagctgggtttgaatcttcactcatgcataagagctgtctgagtccctgctttgtgctatactgtgtgcaggtaccacagataaaatgatgagtaaaattatacatggccccttttcttttgtggcttacattatagtggctaagacaggaattgagtaaataataataataatgaaagcatgtaattaaaaagtgaaatgggtgctctgaaattaaaatatagtttgaatatttgtcccctccaaatctcatgttgaaatctggtccccagtgttggaggtggggcctagtgggaagtgtttgggtcatggggcaggagccctcatgaatagcttggcgccctccctgcggtaacgattgaattctcactctgttagttcatgtgagagcaggttgtttaaaagagcacagtgcccatcttcacttctcttcctctctttctagccatgtgacaaatctgcagcccctttgccatgattaaaggtctcctgaggccctgaccagaagcaaacgctagtgccaggcttcttgtacagcccgcaaaactgtgagccaaataaactccttctctttataaattacccagactgtttataaattacccagccacctttatggcagtgccaaatggactaagacagtaggcaaataaaatgagcttagaaatcttcatattaatggaaacttaaatcttgagcaaaggtcaggaaagagttcactgatggaggaatttaaggggagatctgaaggttaagtaatatatttattaagtaaatttagtaagtaaatgaagggtgaggggcttgtgcagctgacaatattctagagtggaaaaatgtagtaagaacaaacgttttgcagagggaagaaacacattgtattaggaaaatggaaagaatgtcactgtggctagtgtacagagaaaggaaagaaaatgaaaggaaggtgaggctaaagaaaggagaagaggatacaccacagaaggctttgtaggccatttaaagtatttgggtctttgtctagggtgccacagaataaaatgaggaaaacaaagtggggcttcagagctatgtaatatccatgactaatttattgaaaagtgaatttcaatgaacttactgaaaatatgttgaattatcctcacaatcacaaaatcttattggcttctaagtacacttatttcccactcaatggtctgaacatttcctgtagcagctctgctccagatttcagactctaggcctgggatctctcagaatatctcattagggactcaatatctacctggacaatacttttcttatagcatggggtgtaggagatgggggcggaaatagcatgagccaagccaaaccatggaaacacttttaaggctctgtttagagatggtttatttccatctgttcacataaatgctttccattaactgaagcaagtcacatggctaaattcaaacttaatagaaggggtactccttccatagagggagtgtggagaaatgtgattatttattgaaccataatatctacctgaaggattttctggaagctatgggttaggaacgttaaagaacaatagcaccaggcagattaagcaggcaaggaagactttattcaagactattgcagtatgggagaaagactgttgcagtaggggaaagagattagcctcaactccagtgaaacaaaaggcagaaaatgctgagatgaactaatgctgagatgaactaatggaatagtactgaaggacattaagaaaagaggtttgtctatttgattaagccatctgtgttttctaattgttttttattgatgttaggctcctactctcccacagagactggtagataaaggtattaatactatcttttttgatgactacatttcaaagaaatggcctccaggcccttgagaaagactttcctggtatagaagatttacttctcaaaagtgcagagaaagaactcacaattgcaagttttaaaaaagcaatggtctgagaaaagtgaagtcaggggcttattgttaggaagaaacctgcctaaattctaataaagtcgagggaaaaatgtaagactgtcttggtcagaagaaggaacaaccatatgcttagaagcatttcagcaatgtcccttagaattccacctttcatgagaagatactctccaggcattgttggatttcttctttgaaccattgattgtttagcagcatattgcttaatttaccaacatttggggattttctagttatcttttggtttatgatttcaaattaaatttccattgagattagagaacatattttattttatctgtgagtctgctttacaaaaatatttgtaaaatgttccataagcacttgaaaataatgtgtttttgtagtaattgggtacaatattttatattatatatattaggtcatatagaatatatattttatatatgtatataaggatattaggttaattgaggatattgttgacaagattgataatggatatatatgcagaatatggtaaataaaggaatcaagaataactctagatccttgctttgtggcttgacttgagttgcagtgtgaatgatgaggacatttttctgagaggaaaactcagaaaggaacaggttcgagtaatatgtcaaatttggccatgcgaagtttagatgtcatttgacatacaagtggagatgtcaatccaggagtacagtataaaagtttggagctcagtgaaaggataggaagctgattcacagatttgggagtctaatagtatcacctggacagagcatttagctagagaagagtcctaatgtatttcaacttcagagatagaacagaggcaaaggaacaagcaaaggagaacaagaatgagtctttaggaaagtgagaggaaaataataagtttggttaacagagtcaagggaaaaaatgtgttttaagatggagttcagtggctaactgtgtcaaatatttctaaaaggtgaagtaatatgagaacagaaaaatgactattgattttgacaatccaagacctttgatgaccttgacaagaatagttggcaaaagatggtataacacccatattttttgccaatagaaaatttaaaacattgtttaattctgaaagaataaataaattcacacatttatcaatctcctgctgtatacaggtcactggggacacaaagataacaaatgatgttttaagctttgatggagctcatagtgttggagggaatcagacatgcaaaaacaaactaaaacaaaattttacaagtcctgggcaaaagatatatccaatgttgtggaagctggagatgcctatggttattttaactgtgggaaactaagaggaggaaagactggggcttgagaagtgcttgacggttttcttggcaaacattagaggaaattgcattccaggctgggcacggtggctcacgcctgtagtcccagcactttgggaggccgaggcccgcagatcacttgaggtcaagggttcgagatcagtctggccatcatggcgaaaccccatctctactaaaaatacaaaaattagccggcatggtgacatgtgcctgtaatcccagctacttgggaagctgaggcaggagagtcacttgaacccgggaagtggtggtttcagtgagctgagatcatgccactgtactccagcctgggtgacggaatgaaactccgtcttaaaaaaaaaaaaaaaaagaaagaaagaaaaagcattccagcatttcaaaagcattgaagaatgtgctctaaaggctcagaggcagagcatttaatgaaataatcagagaactgtaccatcacctctgagataattagaaatgtgtgtatgtattggatggggcttggtcctgcaaattttaggtgttactggcctttaaaaggggtggagggtactaaatatcctgtaatccttgggtggattctcttgatcaacttatctgatgcaccccaatagggtgtttccctgtggaattgtaatagaatatattagagtgtgatacatggaaggacaggtggtggtggaggatgagaagagatgttggacagtagagagatgcaatgataaataatggcagatattttagaaatagaatacatttaacctggagaccaatcagttgggtctgaggtcaggcaaggttgtgactgccaccttttagatgtgagtcactgtgtggatagtggtgcttctcaatcagacaggaatatatggacagagcagatgtgagcctgtgggagatgttgaatttatttttgaacaggttaaattttaggggtctatgggaaatattcaagtataatgtccagtataaaactgaaaatagaaatctggacttcagaagagagattgggaatggagatagatttgagaatcatgggttaataataatgaacattatagtaatgaaaagttactttaaacaaatgtaatgattcaaggaaatatatatttttaatatgatcaaggagagtatttagaaatttcaaatttccaatttattttacatagtctctccttggtctgaaaattactaggggtcaaggggtcaataatactatgatataagatgtttacttcttaattagttcttaataattgaattatcttatttctgctgacctttccttttttttttttttttttttttgagacggagtctcgctctgtcgcccaggctggagtgcagtggcacgatctcggctcactgcaagctctgcctcccgggttcaccccattctcctgccccagcctcccgagtagctgggactacaggcgtgcaccacctcgcccagctaattttctgtatttttagtagagatggggtttcaccgtgttagccaggatgatctcgatctcctgacctcttgatccgcccgccttggcctcccaaagtgctgggattacaggcatgagccacggctcctggccctttttttgtttgtttgtttgtttgtttgtttgtttgtttgtttgagacggcgtcttgctctgtcgcccaggctggagtgcagtggagcgatctcggctcactgcaagctccacctcccgggtctactgacctttctttatatgttacttaaatactacttgaaaagttatcaaactgagataattttctttccacttttcttattaatttatattttagtaagtaaaaataaagtgttttccttaaacaattgacttttctaacctagtaaattataaggcccattaatgtttctttaatactttgtattcccaaaaaggaaaatcttaatgtaataaatgattttgttgcaatattttatcagttatacttctaaagactgatcatttctatactgatatacttctaaagcttatacatttatagactgataaaaataattttaaaataaatttcttcacagtacaaatggagattggctttacaacgttactcatattctcgatgtatcctttaaattcctttacaacatttgtattacagtttataatttacaaattattaatagttgctgtgttacttaattgttaccacaattctctgaagtggatgtcagtaatgttatttcatggaaaaagacactttagctcagaattgaaggtcacgtagctggtaagggttgaggggccctcaagttggttcctccaccgcgagcccgcagatctttgtccatacccgggcaatttcaaagccatgtcagtacttttgttaaaacacctgtttgtactgcttttacaaatcccttataagcacacactaattaggaaatcatatcctttatagaaaatggccaagacgtgatccatcttttcctaaccctctgtctttttctcaactaggcactagtaagcatcttgtatgaaactgaaaaagtactacactttttgggttataacaaagcaaggttattttcatctctaacagttcctggctgatcaccgtgttccatgccacagaaaagcctttaattcctttaaacaacgtactgaagccaagaattagcattctttctggctgaattgcaactgcacacaggttggcctctcatttttacaacaatgttttcattaggtcagctgaaaggctgacttctctgaatgcaaagtgagaaacagacaaggaagaggagtttgagcaagaaataatctctagtgagtcccttgtgtacattttctcaaattttaaatagtaagtttattcttatgtgcaatcaaggactatttatttttattttattatacataagaatcttttatttttatgttattgcatatgttcatatataaacatatatgtttacatgttctttcaaactctggtggtgtccccaaaacagtgtgctgtgatgatcagcatgaaccaatcatcccaaagcagggtctacagaaggtctgagtgggtataattgctttctagtggcaattcattattgcaaattacaaagtcagatataccatagtgcatctgtgtggaattataaagtattcattattgttattttcattcctagattcaacatgctttaaaaaaaacataaaataaaaataagcagaataattctatgaagatgaattttagtagttgtaaacaatatatctttttttctgaaacacatgagcaattgatttttattagtgggaggggaagaataacattgcactaaattcaatcttctgataaacatgatgttaatgttattaaatatcatagccaattgtaattattttggaaacaagagcagactatgaagtgcatcttgtgtttgcccatggccaacaattaaaattcaatttatacaggagaaaaaaataaatacattatagatttggtgtttaatgatatttattctgacatttatgaactgaactctagtatgtttcaattaacccagtgtaagaggaaacaaccagcaatgtgagggcttatttagttagatacagtgcataggaacttgtcttcatttaaaatttttgtgttttgttcatcatgaatttttgcatcaattttgctgctttaggatattgcattaaaatattatttatctttattagggattttttttggagttcccttaaattttgcacctgaggcaagtgccttattgtttcatcctggtcctggccctgtactgtttagatattttaaaggcaataataaattgtaatatttatagaaatatacctctaggaaaggtttcatccttggcccagtaattagttatgtgtaaatatctctaacagaacattattaaaaataaaaaacgggaaacatatgtagagaggagaagacctaagggcctatgaactctgttgcagagaagtgagaagagagttctgttaggttgttttgcactcaggcacagtgttcttttgacaggtagtgaaacaaaaactgtaaccctattgagattggaggagctctatagccttagtcatgccaagctttgtattttgttaaatactaccaaatccctctttataaagcaatcaactttttttagcgcctcagagtatgccactgttacctggaaagagggggttccttggagaataaattggcagtctttgtaacctcagttattctggagaggcattcaccaaatcagtgatccagagaaagaacagccctcaggcccagggttgcattcagaaaattttcagaggaaatcattaaaatctctttgagtcttttctaaagggccaacttagatgcaatattatctggaactggaaataaaactagcactagaataataaaattttcagtaataaagcatatataaatggaatcagaacatttctatggtaaacttttgttaaaatacagccattagattttcatatgcatggatgtgtgtatatgtgcatgtgtgtgaatgtgtgtattttcaatgctttaggtattgaagccatgaaaagaattagtaaagggtgtatatatagcctataccaattcacatattgggttcaaataggaattttagagtctagatgccatataaggaatacataaagcttaacatataatatgccattaacaaaaatataatcacaaatatttctaaaatgtgtataaagaggggatgatcagagattgtgcaagagactgagactggcctgacttgattcatgctttttctgttacgtgaactttattggatagtctaaagcacatggtatatgcaaaataataaatataaaatatgaagctattacattttactagtgacaatgaaataagcaggggcgggtgcattatgaaactaatgaggtggaaactcccttattagtgtttcaattttaattcattgttttccaatcctgtgagctgagtcttgctttgcttattgagtcagaaacctcagtgcattttcatttgttcataattatagtctgtccatgtactaaagaagcctgctctaagagaaacccaggaaataaattcaataggatctcatgaaacttttagaatattctaataagaaatcacattagacataaatttaattctgctacaattagagaaaagattgaggcttgtgaaagcttgttgaattaggatcacactcagagagtattagaatctgggctagaaccatttctcaggcttgcaaactaaaattcttttcttcatatcagtctgtcatcctgtattctttccatgaatggtcactatgtatattttttactttggctttaggataatttgccgagaagcttaattttgaagtaaaataaagtcaatgtctagtgttatttatttcttttataatgttgttcttgcaaatattctgctagatatgggaaactctatatatttaagagggatatgttcttatttagacagcccagacagaggaaacctgactatttatctaatctgtgctgatgcagaaagtcctcaattcaggattagtcaatgatagtgtaaataagtgggaaagatatgtattgctgctttcatgagcaactgagctgcagaattaataagcacaataggcacctataagctgtgggttgcctatggccctacccaaggagaacggccagttgtaaaattggttagggtgggtggtgtatttatgaggtgtccaaaaaataaaatatgagatctattataattatttggtaatactaattatttaataatatcaattttatatgatttttaatttttgtttaaaagacaatttaaatggtcttgatctgcaccctcttccttaatgctatgccgagggaaatacacacatagcaatttggacagaacacatggcaagtggcagaggaggattagaatctaagtctccagggctcctggctccttagatttctcagaaaattatgcttgtaactttatatggtcaagtaaatttactggaggagaaatctggttatccagatactggaatactaattttggcttcacctccaacccttcatataaacttttttctcatatttatttcttatctgcaaaataatatactgcagatgttatatggaattgtgaattattcacataattcggaataaagttgtttctaaattgccttcaagtatttgtgctttaaagatagattattttttatccatgtggtacaagtaaaaagcaaaaagaacatgaactttctttggctgaagcaatcacgctcatttgtttgtcatcacatattgtgtcttatcacaatgtaatagatgacttccatagtaagttacctagaggaattttaattataatatgagaagttaaagccagagaataaagaattaaaatctaatctggtattaaaactaagaagaagcaaaatagaggggagatattaatacttgccacagcgttataagtttgaaagattaactttatacctatacctgtacaatttttgccatgttttctcttacccagtaattcaatactgtaagttgagtatttaggcttatgaaaaataaatataagtatcattctgtaccttgataatttcaaaatgaatattgagctgatgttgggaaggcattgaatatatcttaacaggacaatcagattattatggctgtgacataagaatgtttctctggaatcaatgcgccagataaactggaaaaggaggctaattaaaaagttgttgtaattgtctaagcaatagaaagaagggcttcattagcatggggacagtgagactaaaaagattgtagaccccattaaaattgccacttcacatgctgttaatttctatgggaagtggaactaaaatgcactgtgtcaagctcaggtaagtggaaaagaagtatacatatcgtgtgtgcgaatatatatcgtggattggatatacgcacattggatatacatatattccaaacttttgtaactaatcttagataggcaaatgtgtataaactttgctttggttgatatattagttcttttaaaaattcatgcaatatatccaccatatgttgactctaatattaatgtttctgtcaaataacaccttcaaataagtttaaactccataaaaattaatacctgagttaaagacaactgaattccatatttgttttatgagacaaagtgctgataaaacactctatgtaagcctgtagcctactccttttctgctctgactggcttggcacttttcgttttagaaaacgatagttaagtcgttttagttttaattttacattcatcctgtacaacagtgaggattcagacatttttccatcctttcaaattctcaaaacctatatttatttttaaaaatataagaatagatgtgtaaacctaggaaatgattttaatatacatagttaacatttcattgactttcatatgttaaatctgtgctgtgtgagcagcaggaagctacagagacttccgaaaacaaaacaaaacagtgttagctttatgatagtgctcagcattcttcactttaaacaatgtttttctgacctctgaccagaaactgtatatatatatatatatatatacacatatatatatatatacacatatatatatatatatacacatatatatatatatatatacacatatatatatatatgttgctattctaagtactttctggcaagtgtgagctgttatccctgttcttaacaagcaaattttgcacaaaaattagagcatatttccaaagcaatgtatcagcaaacattagtttacattatatataattgttagaagcatatctttagtattggacacagaactccagatatgatctcgtcaaatgcaattttcatggaacttatttttgtcagcacacttaccatcttctttctctacaatttaagctcaacgacggaaaagatgtgtttgacttgttctcattggttgtcactgtatttgcaatgccctgaagaagctggagtatagaacaagctgaagtaggcagaccctcatgagcaaaaacatgtaattccaaacaaggaagattgtaagataacataataacttggttgatataggtgggacgagttgatcagggaagagagaagctcaaaacaaattgaagactacatttttttttgtaaaattaagatctgtaagtgaggattggtgacaaaaggaaggagcctcatatttgaaagagctcctcagaaggttgccaagtagtgtggggtttgtattgttggaaaggctctctaaggaaggcagtcacgattgtgatgtctaaagagaatttcaaagactggattcatctctgaatgtttaagggaagacatcgatctatcagtagttcaattattcatgagagggaaatttgcaatctcacaagacagcacatatttaaagaatgattatagaaaatatatgtgatctgatgagagtctcctccaaggagagaaaaactaatggtgattgtcaactttcatgaatattttaacaaataaataaactcaatgtgataaagtctgctttataacgtattctactgcttcctctccagtgtaatttcatgaataactacagaaatcacacacttaactctcatctcaatatataatttagctattattgaatcttcttgcactaagagaacatttaaattatgcttttagtcttctacttttggccttttttttttattacctttctctagttttttaaaatcaaagtttactaaaatatttaaaagagaaattagagcaactaagtctttttaaattttttattagtatggttaaataatagttgtacatatttataaggtacatgtgatactttgatataagtatacaatatgtaatgattaaataaggataatagagttatccatcatctcaagtatttatcatttctttgtatttggagcattccaattcaactggcttaatttaaaatgtacaataaattattgttaattttggtcactcttttttgctactgaacacccgctcttattccttctatcttactatatttttgtacccattaaccatcccctctttattgttctttctaatgtttaataggaaagtggttatttatcttgatctactatatggaggagagattttaaaaataactttagatgctgtatttggaaggaaactaacatatttaaatgaagaccacaattaaatgtttttaaatataatgcatgtttctttaatataaatgaattatatataatgtaatgtatatttcctttggtagatattaatttggaaaaatttttaggtatgagatataattacctagaggcctagaaacttgggtaagtagtttatctttagttctataattatttttttccattatattttgggtactaaataaatgtctctttgattacagatctaagcctgatatcctagtagggaataacatatgtatattaggactaggccacggtttatctttttttctgtttactttttacttcatttgagaaatcgtttctcctaatcacaagtaaaatatgaacatactttaagtctggaaatcagcaattcaaaaactaaagtgtacaaatacataaatccatgagtttaaagaaagacagtagaaagacagagttacataataaattttgttatgtgtaggcaccagcaagttttttcttataaattaagacctaagttagacacaaataactaagacaatggtgacttgaaatgctagaaacattgcggggtaacattgccaaaaacaagtaagcaaacaagaaaaagccccagagatcaatgtgagtcaaaaacgtagtgtaagtagtatgttgtcactgcatagttacttcatgagtcaattacagatatagatagatttttaatagtataaaacaaaagttttttgaattatacagtgtagcttattaattatccattgtaaaagttacaatagcaactatttagggcatttgcctcattccacatgttgtatggtaatgttattgcagcccaaagcactgatatttctctattattcctttgttttaaatttctattcttttttatttaaaatgggccacaaattatagtttctgtgttatactagccagtgtacagttgggactcattactgagtatagaattctacaacactgtaagacagataagatcaagagttctcaacaagagttggacacataagataaaagtaaagcctttataacaaaccaaaattcactgaattgcacacttaaaatagatcagttttggggtgtgcaaattatatatcaataaagttacttttttttcttttgttttgttttaagatagaaccaggagaggatttcacttccagccattattgatttgtgactcgtaattcttaggtcttctgtgaaatactgtggggtcaattactcatgcctcatttttatattttgaattgctccttttttccagatacattcccaactttaaaaatgcccattgagcttacattcttaaaaacaaacaggaaacaaacaaaaatctttctctatccctacttccttcttttctgacttctaagttttagacttaagaaaggaatagtctctgtattatttcaacatctttaacacctccctttactattgggttgagagtgactttgcagaattcaccagttactcttgaattgccagctataatgatttctgtacaattctcatttttctagaactctatcaagtaggcgacacacttaagaaactcttttcattaaagcagtttttgtttttggcttcagtgacctatttttaacatgttatatattttctctggccacacttttatactgttattttgttttttgtttatcttgtatatcccacctctcccagtcttaaattcttcccacttatgtcccctgattctcttggcattaactgtcacacctctataaaaatggcatcccaaaccctaactctagccttgacctctctctttactttgggtacatatattcaacttcctttttgatcaatataacatttctcactaaaccttaaagcgaaaatcatctgtctttctccagactctatctccaatatcaagtaatagcatatccatacatctagtcaaccatgctaggatagtcagggtatctaattactatgttttttttttttaattctctatatccaatcagttaccaagtcttatcaattctatcttgaaatttcttttatatatgaaacctttctgtgtgtatataataataagctcttcctaggacttaaaggaagggaaaggctaatgttacatatgctgtctgggaacacagcatttcctgaataccttactctttggtaacacctaggcgaccctcctggcacagagtttagcctaatgtaaaagaacaagtcttcagggtcagcacaggatgagtactatcacatatggcatattgcagtgaattagaaaaagattccttctgtaatatacatccttctttttaaaaaagtcacaatgtaaattttttaagaaaaatatattttactgccatctatgggaaaaagtctggaatgaatatacaaatctgcattgtctatgctctgatatgtcgtgttctaaggggtgcataaactgcatgagcacacatggtagctctgcgtaatgctgtgcttttcaaaccccggtccaactgtttagtagcttaaccttggtaatatactcaacaactttgagcttcagattcatcacctatggcatgattaataacagtctctttcagtcagtctttgggaagggtaaatatggaaatatgtataagtaataagcaacttcaaatttacctgtagatgtttccagtctactgcctcaaaagcacatcatgacaagataccagattatggaagtccttacgctaatgtaaaggggcaatgaaaacactgttggttttaacatttcactacaaatcattaaacatgtcttcaggaatatttatttgaggtcatttcaaaagaaccagaggaacagtcatcctatttttttaataactcaggatgtagcctggaatctaattgtacctgaatgttggacaaaactatgtgaaggcttattaccaaactataaaaaagtatcttggcttcaccatttccatgttatcatcatattttattgttctcctatttcagaggtcagcaaagcacaggccatggactatatccaacccctgtactgtttttgtaaataaagttttattggaacatagccacatgcattcatttatatacagtctaggctgctttcctgatacaagggcagaattgggtagttgtcacagagaccatatggtctggaaagaacaaagtatttatctggcctttatgcaaaatatttatgaacccctgattttttatccattttaaaataccaattcacttgactttccattttgctcaattctacaaatagacaaaaaatattatattaatctggagcatattgagtctcattttgcctttcaaagtatcttttatgaatgaacataaacctaattatagcatgctggcttaaacacgaacaatcccttaggttttatcttaaaaaacaaaacaaaactaaccaaaaaaaacctaagacaaagcaacttgttcatttttgccagatttttattggaactacatagaaaatatttcctataagaaattggctctcaacgactgattgttttgtcattaaaatataatagtggggaaaagtccatttagtagttttagaagagccatgttatttgatgatacagtgactgagttagttgcctgtttgaaactatttttggttgatagtcaggaaattccatgagtgcctacttcattcattaaatcaagtagttgaaacctttccttttcatatggaaaaatgactaaaaattaggcagcatattgttatggaaaaatatgaacagtcaggtagatgtagtcttactcaaatactagctgtataattttgggatagactttagtttccacatttctgaaagcaaaataaataatctttatttttttaaggatttttgataattatgttaaaatcttagtaaataacagtttcttaattaatagtatggtaaagattgagttcattaagtaaaatatgtcaaatttactcagaatattcttcaaaaagtctatttctcaaatttccccgtctgtttgtgtgaatttatttagcaatttgttttgtgtgctacttctcattcttaaaaacaagttaagaacttaaccttactcacctttttccacttaccttttaaaataattctaccaaggacacttataatttaaaagctagttgtctggtatcatttggatgtgtagatacagctaaaggaataattagttatggagtaagaaaataaacagcaaaccttaagagattaatttttttattgagctttccgaagtcctaaacatcagtggccagggattgaaccttaattataagtacagcctccaaaagcattgctgtcatttaagacattcttttaaatgtgtttctttagagttaagccatgaaagtgaagttttcctattattgactgtaaaacagttaagagatgctttggaatccaacatagaagttcctcaaagttaaatgaaaataagagcagaagttaaatctatttttaaaagaagaaattgaatataaaaagtgtcattgccattgatatcaaagtgcaggtataatcatagttcagcaggatatattttagctagattatgaaagcttttcacagatgagtgcagttcaaagcaatctgattctggtttctgtttctgccattgttatgaggactcttttacattggaagactaaatctccccaaacaggtgtcattctggagcaaattgaaagagtttgagcttggattatagtgaggattcctaagatcttctggaccacgtgtctttctcttgaaaagccttcagaccgaagtgtgttctctttttatatcctattctagaccatagtcctaccatgcctaaaagtgacctgctttggagatacggctgatcagtacaggtatatggaagaaattctctgtgaattttgtaattcacaaattttaagaagttgctacaattgtacaggatgatcatgggaagctatgtatctcagtttgtctacccaagatgggcatcctgggaggatgacaggtgaacttgtcacatacatatcccaattgggaaaaggaataaggaattatctgaatgattaggttttgaagtttaagacccctaggaattcaaaatattcgagaagaaaattctgacaatgatcaataatttatttagttaacaacactgtgggcagctacaatatggtttcagctacaatatggcagctacagtatttcaattgattcccatgctacctatcaaaataaaataaaatttgaaagtctttcttatatttgcatgtctgatattttcatagagagtgccattgtgtgagaataaaatgtcaaattctctattctcgggaggctgacatggagggatcacttgaggacaggagtttgaggccagcctgggcaacacagtgagattccatctaagaaaaaaaaaaaaaaaaacaccaatcctcatttcaaggttcatctcaaaaatccatgaatcaaaagaggaggcctttaaggagaggttaaggcattctattcaagcctctttttttttttcagaggttcagggtttgttgagtaggaaggtatgatgtggctcctggaatgatgctcataccaaagggtagaattttcatttttaaagaattttgtgcaaaaatgatggaaatcttttttttttttaatttctaagggtgatatgactcattaatgcatcaggctttcttttacactagacagcaatcacatactcactactaaggttacctctgttagcaagaggtatctcatctataagcagctaataatgggaaccaaatagatgaaataaatcagatgtgaaacaaatataagaccctcgaaatgtaagtgaccagcaaagagaatagtgcatcttgggacataagctatgactatattagaccttcaaagccatatttgcacagataggtaaagtgctaggaacaggtgaatgcacaaccgtacctgtgggacaaaaggcctcagatgagataaagagtgaagtcagaagaagagagattttatataagccaccagaagacacaatagcactgcactctcacacttgggtctctgtctctttggacatctgtcttgaccattccaatagaaaatttaaatcttggttcaggctgggccattgatcctggtcccagtcctctattgagtatgtgtcagagattcctgggtgaactttcctctcttttcctaagggttccatgggagacaaatatttcttctgcatgtattaggaacaaacttaaatgtggtacaaattttgttattttattatcttgtatgggctaatgggagggttagtcattgttaaatttctgcctcccattaaatttcatcattaatcaatttttttaaaccaatatctgggttgaaatgagtcaccaaggtgaagaactggaacataaaaacccaaaagcaacatgatcaagtgaatatagcagaataaaaggccctaaatttaattgtttctgtgtgtacactgtgtcttctcaattgttctctattatagtcagaatggatccttattgatttatttaacgcatgtttatattttggtttctgcatctgatctcatattttctcaggagaatataatgcttttcctttagaatacaatgttaattatcaaggtaactgagatttggaaatttaatgggctctttctgttctcttcctactattaattttttattagtcatcttgagagaataaatatttttagaataccatctgaatataattttgtcttgtcacatgagaaattgttaatttttgaagtttaattttgttacataatagtaatttgagtgaaaccatcccctattacctatctatcaatatgcacacatattttttaaaagttccaataatagtgttgtacatcataaagtgggacaaattcagcagtgatattaaagtattatagttttatttgaagtattaatttctaatagaagttgataatgctgagtaagatggtgttttggatatgaaccattaacaggctttgaaaaaataaaaaaaaggtcaaacccttttagcttaaatgtatttactgattttataaatgtaatttatgaatatgccaaaaccttatataatagtcaaaacaacaacttaaaacttcttagggattaaaatgcaactgatcttctatagaacaaattgaaaatttttgctaaaagtaagaacattttaatcttctagttaactaactataatttcataattactgatttgtagatatccactttggatcatttctagtgtagttactagatgaggtctgtctaacactgaaatttgctggagggacaattggaatgatgcatatttgaggaaaatttaggaaaattgggttacccaagtagatggaggtgtatggacttattttgttgataagagaaagtgatttttccagcttcataactgatcccctgattccagtattctctacctgaaaaataatgggctgcattttataatatcatagttgagtgaaagaatccacaatctatatggggtagccaaataaaaaaaatttaaaatgacgaattgtctagtttttccaaggtataaaatgatgacttaatcctaacagaagcaatagaggaagggtgtgcatgctgttgccagagacataaaggaaataaatatgacagtatttatgatagattagatgaaaggaataaagaaaagaggagagaaattggttttggggtttcttctatagcataagggaaattttcaaatgaatgtaagtaagagtataaactgttttgttagagaacaatatgagtttggtctctattttgcttttaaagtaccagtgggagctcagcttcatttattctataggacatagaaagtcgagtgaagaatagagtcaaagattgagtcctagctccattaaatatatttattaaagattttagagtgggtgatttctctgaaagaattagtataacaatagaagaacataaagctggcattttaaacataattatcagatgaacagttttgaataaaatatagctgtgtgagatcaaaaaatatatgtgagaagatgcaagctgaaagccagtcttgcctcctataactgactcaaaaatctcaaaagattttgtgagttttgaatttgttttttgttagtttgcttgaccttaaaatgttgacttctacaaagtgaataaagtagattaaaggctgatcatcagactcccttgataatgcaaattacatagaacacaactctagtaaacatcaatttcaatatgttattgacaatgtgacttctcttaccttaagcattttctttcatatggtattatcaccattccagtaacaatgtttcaggtaaaacatgatttaaaacaacttgtattttagaatcacaacactcctttactcgttgtgtgaaacacgtaaatcaggtaataaaaaaccaaatagatgaataaagaagggaaactcttcttatgctagaaattcattttgagagatgtcattcattaatgctgaggtaaatattataaaaatgaaagacactttttcttaacattagtaaataaaatatagatggaaattatatgtgtaacatagttacaaatttcttaccaattaatttctttatactgaccatcttcacttgtagattaaatttgtcaattttatgctaaattttcagctaacagtaaagaaaaatagatattctcttcaagattcccacagtgtagttaaaaatgtcagctatgtaaacaaattattacagcatagtgtaatcccctgttacagaagcccaaagggtgctattactcattttgactgggtggttcaggactagggaaaatatgaatctttatcaaacttctaaaagaaaatataatttctgaatttagacctgcatttgtctggagatgagtcttcatatggcgctatcaatatatttttagaaagtggggatttaaaatgtgaaacttgcacctgtggtctgctacttacttttctcacacagcagttcccccaatagtagtactttagttaaatgcattaagaaattgagtggaaaagctttggtaattgttttatttaaggtaatggaacttatatacaggcaatgcaatgagtcacttcagtttttcaagataaattgagatagttttaaagattatatcgagggttctctttctggcaggttataaatgaaaaactctaaaatgtgactgtaagaaacttgtttttaaatgttttgctgagcgggctagaaaagaaagtattccaagaggataaagatgaagtgaaagcagggaccctgagaggcaagcaagtgccaagcttggaatgtaagataaagcctggtttgcccaagttggagactgatagaaaagctccccagagagcaggatcccaaagggcaatactgtaagaacaggttcaacagggtcgtgttctatatgggaaataaacctatcactgggaatatacatcaaagaaatgtacttacccacaccttcccactgattggattggcacaaatctgcccttagaattcagaaatataaggtagctttcactcaggtttgggggcagaattcacctgcgtggtccaacaaacctcaactgatacttttgtgtggttacagattcatagtcatggggtggatgcaaaaggaatccttcgtagtgtgaacctaaattcaaggcatttcctagatacagttctaaggaaatgagtaaatcatctgaaaattataaaatgtaaaaaataaaatagacttaaagctaacaaaagcatgacaggagatctagacttacaaagatttcagatattggaagtatcagacacagaaaaaaactatttagtattatattaattttcttttgctgtctgtattgttccatttttgcatcactatgaagaaacacctacagatggggtaatttataaagaaaagaggtttaattggcccatggttctgtaggctgtacaggaagcatggtgccagcatctcctcagtttctggtgaggcctcagggagctttcactcatagtggaagacgaagtgggagcaggcacgtcacgtggcaaggaagggggtgagagagaagggggaggtactgtctcacctgtctgtgtgaagagaccaccaaacaggctttgtgtgagcaacaaggctgtttatttcacctgggtgcgggcgggctgagtccaaaaagaaagtcagcaaagggtggtggattatcattagttcttgtaggttttgggataggtggtggaattaggagcaatgttttgtgggcagtgggtggatctcacaaagtacattctcaagggtggggagaattacaaagaaccttcttaagggtgggggagattacaaagtacattgatcagttaggatggggcagaaacaaattacaatggtggaatgtcatcagttaaggctattttcacttcttttgtggatcttcagttgcttcaggccatctggatggcttagcttgggctcagaggcctgacagtaggatactcttttaaacaaccagatctcacattaactaactgagggaggttcacttattaccatggggatggtgctgtcatgtatgagggatctgcccccatgagccaatcaccttgacctggcctcacctacaacattggggattacatttcgacatgagattcagaagggacaaacacccaaactacatcactgccataacaaattatcacgcacattgtgtcttatgacaacagctctgtaaaaacatagttctgtaggtcagacgtccagtatggacattaccagactaaaatcgaggtattgttaggttatatttctctcttgagactctatgggaaaatcattctccgactcatttgggttattggcagaagtcagtttctgtggttataggactgagctccttattttcttgtgctgctctaggttgaaggttgcactcagcttctaaaggccaaagaatgcctttgtgtaccacctcttcatcttcaaagccagcaacagctgattaagtccttctcacatcacatctctctctagccctttcagtctaatctggcagtgtttctggtgatatgaaattctcaacaactctgtgagtgtcttgtgtatgtcacagggctttacttcattagataagaggcatgtccatggatctttccaaggtgatcccttcatttttggcttctgctgagatggctgaagggacttataaggtagaagatgtttacaaagtggttgctttgaatattattagtagaagtatgggcattagagactgtccaatcttcagaactggaaatccaagggaaactgaagcaggataaattaaaagaaaattatgcctaaacacataaaaataaaatgcaggacgtcaacaataaagaagaactggaagcagagaaacaagggaaagcatcagtgaaggaaaggcaattggactgataacttctaaattgcaacaatggaatccagaagatactagaatgtgggatctatctagaagattccatctctctgtcaataccttccatgtcactctgctcacttccatctttcagttatacattatttaaccggcctcattattgtatttattcccttgtcctttaaattcagtttagcacttctaatatctaataaatgagtataaatctgtgtcacatatttaattattcatttattcaaccaatatttgtcatcagctcactatgatgttcgttataggccaagatttactggaatactggggatatattaaaaaatctgcctctatatcaagttatttatttatatcaatttttccaatttagaagttgtaagtataaagtcatactgttcatcttatttataatataacctctcaattgtttatcacttaaaaacctttatctttataacttttatcttatataattttcgaacaattccatggtctctcctaaatgttacagttgactcaggacttggcagctatcatcaatcaacaataatttgtttagcaccaaatatgtgctcactactctgcttagcacttttgggcacacggggaaaagtgttacagcacagctgcatctttcagtgtcattagagactattcattatattgcatttggcagactctgctttttgttatttttataattgaattattttggatttttaataacttctagttcctcatcacttgtattagaataaattatagaatagatgttcaaagttgttgctttatttttctgagcatgactaatataagaaaatctcatgacttttcatttcatttcatcaaaacaagaattccttattaagtaaaagtaaatccaggcagtcacagggatttagtgcctgagattcaatgaagaataaaataaaataactgtgaattttttcataaagcaaacataagctttattttttcccagaattacacaatgacattcacctggaatgtaggaaaacattttgccaaattctagatgaatttcattgtgtgattcatctggaatttaacattttgctgaatttaataatttactaaattttgctggatgtataattttatctggaaaatatataatgtggcatctcttatgtagaggatagaatattagtgttaaacagaattggtttgaaccctggctttgcaaactactagctgtggttgcttaggcaagctgtgtatctcccctgagcctcatctcactattaaaaataaaaaaatactagaattcaaactcagtcttttttattttgaattatattaactccaaacttggcatgagcatatttgcagaaagtccaatgtctcctcccatcgtccaagattcctagagaattgctccatctaatgttatctgccctgcttccaaatgccaggctcagagaaaaccaggaagttcatccattgatttctgtcactatacacacagccgctatggaaaaatagttcccagcacattctaactggtgattttgcatgctactgaaacggattcctcaacacttgcgagcttcatgataccatctgtcatgtagaagcacctcagccagtgttcctacatgtccaccctgatgcagtagccaggacaggaaaggctgccagcttcagcccttctgcaggagcctctaaaccacagttctgagcctggccatgctctcctttgcctcatggtgacctatttggggctcctgatagcctttcctgccagcagcctcagtcaagaacagaaagacttcaaagaggttccggtagcattaaaatcacaaaaggatccttctccaacaaccccaaatgaccccttggaaaatttgctaacacctctgtgacccaatcttgaggaggcttgagtcagccataatttagcagatcataaaaggacctattattaccttcccccagggaaatagatacctcctaggtgactagaggcaagtaaagtgactgtttaaagttctttctaggtttaagttcactagtaaagcttctctttcttttatgttctgcctcatcacatatatcatacatcgtgctattgttaggattaatgagatgacatatgtaaagtacccgctacatagtagacactttatacatgttaattttctctcgtgttcgatattcttaatttttaatttagatcttcattgctatttttcattttcactatatcccacatgagattatagaatctatagagggagttatgtcttatatatctttcacatccacagattatttagtataattccttgcagttacatattaattgctatataattattatttcagtgaatactttgagattgattttttccatatatagataataaaatctgctttttaaatttctttgtgtgactttctgctatgaaagttattactctgagaagaagcttggcaaggaaaggagatgaatttctaatccaactatttgcattttgataactgaatcacccatcagtcaataacacttaaattgcttagaaattttcttgaacacttgaaataatgggttcccttctttctcagaaatggtgaggcaagaatacatttgtaagaggcatactgttgcaatgaaaacaacctaaagaaattgaaatttgaattctgaatctccactgatactgacaagggaacaggcaagtcatttagtgatccttatttggcaaaaaggggatgacaatgaaaagatcattataaggattacagaaaatacatgcatgctgtgctgtgataggaactctttaatttaaaaaatgcacacacatgttgaaaaagttggaaaataaaagaaataactcataatctcatatctcatggataagcttttgttaacattttgagatattttgagttcatatatacctaaattttaatatcctattttttacttcatgtttcattgtgttgaattttgaacttttccatgttgtaaattcttcaaaaatattattttaatgctatactttatataatgtggacatttctcatggttataccaaattttttctattgtttaacttaaaataattgtattatcatttttgtaaaatttccatatttctgtatatttccttggaaaatatgatgggaacacgtggaagattcttactttttagatttacacctttgatatctgctaacttaacatttcttcttccatctaatcttgaaatacctccacagacccatgacttgtataaatctattattttgctgatcttcccacatgtgtgctgcccagggctagtgttaatagcatgcactttgcctatattaaggaagtctagcagctgcatgaccctctgcttccttctagctgcaaattctagtacatggaaagacttgtgcaatacatgtgactcctgctcttaaggtccagacccaattggcctttgagatttgtcacatccagctgatgccccttgcttcctctaaaaggcaacacagatgaacttcaggagccagggaatctccccgacaacttccagcggtgggcagtgttatggataggaagccacatgcccaacttgacccagtgagctgttaccacctttatgatatgatcacttcattctaccagaagagctcttagaaaacttgacccctagattagagctttcaatgaacatctatggagaatttaaatgaataggcactaggaattttctctgcgcatcactatctcccttagaaaaatagactgctttgtcctcatctcactgcctgtatgtacctccttgccttctcactgctgtccagactttggaccctagcagcactgaaaataccagggatactgctgcccagtaaactgcaggcaagaagggtgtacagcacccctcattcaaaaccactttccaatcttaggggagaattttctgtccacatctcctgtcccaccgccaaccaacacaagaaaggctgcgatgtgaatctttttttgtccatacattcttctctccaagtctgtttctgaagcccctttaaaaattctttccatgttaaaaaatcccccaaaactaattctacctaattcacatcaatgaccttaattcaaactcaaggaagccccttgtaataattaaggtctgggcttttattctcagttagccaaggattgtcttcatagaatccctgcgttttagtctcagccacagtttgtaaaagagaggctttccggtagtctatgcctggggttaggaaagaacactttcctcaaattctttatttcatattctcacaacaattttgttattacttgtttccgttagcgttaataactaccctttttaagtgctctgtttcacaaatttaatatttgcacacattgatgcctatgatagatatttagttcatcaactttttttgttttatattttagcaaatgaaaagagactcacttttaacatggcattagttacctttgattttgcttaacccatgtcattgtcttatttccagagatggtttatcaccttgttcctgacaatacgtatacgtagagtaattgctcacctcaattaccaaaatatgtcccaaattctctgctatggtctaaaattcctgtggtcaaatttaccacttgaattgttctttgtaaccaaagttggatcattttctctactagaccagttaaaatacatgtgggcactgaatttttcttttgatgaagggatgttgattcagttatcagactagcttaggaataaatttgggtggacctaagaaatacatgtagactattcctttaaatattgtagtcatacacctatattttattactctaaaatctacaatgttcgtttacatctataatcatttttaaccctcacaaaaaactgtgaattatgtagcttgtgcacagagctaataaatagtagaaactacaagataacgtagatgtcactttgttaagatacgcaaaaatggtctccaaaaatatactacatgtcagaaagtatcctacccacatcttcccactgagcactggaaatgatggctgactgcatgatatttcaatgattgggagagatgtttatattgatgtaaataaaataagggctgaaactcctgaagatgtagtctgatcaatctactcatgtttcagagtacttgctatgtgctcagcactgtttagagttttatgggccattcaaaagaacacaatgttgttctatttatcaaatagctcataatctgtgtgaggaaatcaatttaacctgaagaattattagaaaaaataatcaagaattcatagaaaaaaattaatattagggtttggagcactgatcatgcaggaattccgaaaaggcaaagaacaataggggctggagtcctcagaggatgattccttgaggaaataacacatgagttgagctttggggagaaatgggacccagcagcacccaaatctcagctcctccacccactttttaattttgtttggaatgttacctaaactccttgaaccacacatgttgacagtggtaaaatgaggaggcaatgcttattttacttattgtgactattaagtaagatgttttatagaaaatacaagtgcttgataataacaaaaatctccatttcttttttacttttaaaatctattatttaaacttgtttactatttaatgacttttatttgtctttcttttcttctctggacatgtaaaaggaggtaatgaaaaacattcaagaagacagaaaatgaaaattattgtaaaccacagcactaaaataatagatacagaaagccttgaggacacagacttatctgtgggttagtggaaaaaataaattcttgattttcaaagactacctctcttctactttttatcttgatatataattatttgtcttatatttattattgaactatgaggtgttgacttttgtgggtctttttagttttaattgtttatttttatcctccaagacccttggcaaaattccttgcatatagttttttaggaaatgttattcatttgtgtattcattaagtaaatatttcttcagcagtgaaggaaaccaaaaatatttcacccgaaaatatatttctttggcctattttgagatgactattcagacgggttacagaccacaggaatagctctgaaaagcttccctttgtggggggagatttgcatttgtagggaaaatctacattagtgaaataaacagccaggctttctccggagtcctccttagcctcatctaaaaaagattaactcacagaaaaaaagagactcagagtctaacaatcttaaaggtctgatggaaaaacttaccacaggctagcgtctcatctttctgagggctgctacctgtgaggcttcatctgagtaacaagaccatcttgctggccacacctttcctcctttgccttctgtaacctgtcttgccatgctccaatcctttattttttctgtaacctcaggatggtatacaaacttcaactatctggctcttcttttgagtcccacactttatgcatagttccggtgtccatatgcacattaagagaaatttgtatgcttttttcccctgttagtctgtcttttgttacagaagtgtcccagctaagaacctatgagagttagggaaagaaattacacattttgtccccgtcagcacctacttgtggggaaaaaaaaaaaaaaatcaggttgtatatgtaatgtggaaccagatcatgaaacactttggactctgacatcaacattttaaacttataagaaaaacaataatgcccttatctctttctgtcactctaaattatgccttactctagcattcttcaaagagcataagccaagctgtgtcatcctttagtacttcttttatgtggcttcctcttcctggaatcactcccctgtctgccacctggaaaatatctactcttgtcccagcacttagatgaatgaaacattttctgaccttctccttccccaccccttcagggaggttattctagtttctcctttctgcttgctctgaatctagtacttatttttatcacagccttataacattattccatccattcgttcaaatctttttctattataatgtagtactattagaccgcaattacttttgcaccaacctaatacattagaaatgtaaatactagggaagtggtggtaagggggaactcatttgcataaatttaggtcatttctcttatacatacctagtaagtgttccacaattcaaggttttacccagatgtgcgtacaacctgaaaatcttcaggatgctggcaaaataagaaatttagtttaataaccctatcattgtacaatgaggaaaccaactgagataaataggatcattgagcagcactttgcatgaatattttttagttatgcctgtaagagacagcaacattatttttgtattgctgaagtgctttgagagtaatgccctggtgacagcataaacaaaatacaaaggccagtttgtttttatatataaatgggggattgttggtgaagagttgtgccagccagtacagagtggaatagtgttttattcctctcaagatagatagatggctgaattgcccaagttcctgctgttttatagcctgccccttgaatttaataatgaataactacttttttttttttgcatggttggtgaggaaatatataatttaaatgaaactgaacaaatcatatcatcactaaaaatatgttcacctgatattttacctaaatgatatattgccaaaaatattaaatatcctatttattaaacattatggggttttcaaagtaaattatgtctttattaaaatggaactgacaccttgttaatgcattacacttttaaaatgtacagaggtttacagcacagagagatggagaaaagttactataattctgaaaaaagagacgggaaagcttacttctagtagctcccattgggaaggagtgattgggaaaggcttctcaaacagaataaacttgaaaagtgagtctgccaattgaggaaggaagaattagaagataagatttgagtggaatcatggaggccattgcacactatgagagaattttatttttgtttgatagatataaaggagttgtgattattaattttatgtgtcaatttggctaggctatagtacttacttaaccaaacactaatttaggtattgttattatggtattttgtggatgtgggtaatatctgcaatcagttgattttacgtaaagtagatttccctccacaatgtgggaagatctcatccaatcatgtgaaggtcttaagagaaaaccctgaggattctcagataagagaaaattctgcttcaagactgtaggatcacctactgccaagttttgagcctttcagccagccttggggatttcttacttgccaaccctacacccacatcctctgaaccaattccttaaaataaatctctgtaaacatgtctacatgtatacacacacacacacacacacacacacacacacacacacacacacattttttttttttttttgaaacaaagtctcgctctgtcgccaggctggagtgcagtggtgcgattttggctcactgcgacacacacattttattaagcagaatctatacatttaacagaacctatacatatagattatatgtgtgtatatgtgaacctatatagaatacatatattcaaaatagatgtatttagaatatttaaaatatatgtattctatttataggcacatatatataggttctgttggttctgaaaaatacacacacacacacacatataatgcttattctattgtttctcttaaaaactaataaatggaatcaggagttataacaagttttaaacaaaactatacttattacctttctggcagaaattagattctgtaattttaagctcttattggtcattagtttatgccagatttatgctacatgcaatacagtaaacagaagcataaaacaatgccagttttcagggatttctgtaatcgttgctaacagtttttatcacttgtgtgtggtaggcaatgtgctaagtgttttttaaattttttacttaagtaatcaatgcaacattcctatgaggtggatatttttaacatagatattattatatttgtaatttgacagatgaattaattgaatttacagctagtaaatgtcatacccagtgccaaacctgggctataatgcatgaaatatgtattctgccaccaaaatgcacatctgctcatgtaatacaatttaactatgatcgatgaccagtgaacaatgtaaaaccatgcttttaaatattcataaagaaaaacataggtagctatatttcttgtagaaaagggtttctaagcacaggaggcttcatgggttgtggaaggaggctactggcttaaccactaagaatagagaaatagcatagaatgtgatgaccagctctaagaaacattaaagcaatcatggtatttcaaaacctccattaaccaacttcaagtcatactttaatagatttgcttcagacctttagactagggctcttcagaatacggctctgtgactagtaacatcagcctcaccactacccgagagcttcctagaaaagcaaacttggagacttcattccagatattatatatcaaaatctctaggagtggggcctagaaatctgttttaaacagctaagtgatctatgcttgggttaaagttcaaaaagtactgtactagaacaacagggctgacaaagaagagtgccctgatgctgaggtgagcttccccagggaaagcaaaatgaagacatcaagctggagtgaactagaattaataatggttaacgaatgttctgtcttaggcatcttgcaaggtgggaatctgggacagaaataacttcaggagagacagaacttaaggagagtcatggagaaaatgaaattctctcacttaagtgaaaatgagttcggacaaaagtcagaacggtaacaccacatagaccaaaaaggtcaggactgtgtgtgtctaggatcaaagcaaggttaacaatgaggacaaagcttggcaagccaaggagacaaaagtcctgggacaaaagaatcactattctcaagagaaactaaagatgtaagaattcagagccacaggtctgaagttgagtataaactaattatttggaagtaggcagcccacatctattagttcaaccctctcacagttgtcaattccccatcttattagcacctaataaaattatatcttgtgccactggtgcattcacctattgattcaaaaaatatttttggcaccccctatgtgcccaatacagtgataaatagcagagatatgagggtaagtgagacaaatgtgatcccagacatcaggaaagagatactgaataaataattacacaagtaagtatttaataacaattattctaagttctacctagaaaaagtatggatattgtgagtatcacaggacacctaacctatcctgcaaggaagactggtgggaatatgatctgggagtttttcagaggaagtaaattttaaataacaacctcagataaggtgttagctaagaaaagaactggagaaaagcatcccaggccaaaagagcagcttatgcagagacagagagtatgttaggatagagtgggagagtgcccagggtgactggaatgtagtgagtgggggaaaatagccaaagatgaggctagtgatgatacaggacctgccatggcctgttgaagacatagcatagcatcatatgtataataagaaaacatcaaacatttttaagctagtaaataatgatgacactgacattgagaatattcttctaggtgctctgatagagttttggtacagagaaatcttttaggagtttattgcaatcattcaagcaagggaaaatgatggcttggactaggttaatggcgatgaggagagaaagaatacaatggattcggtatatagttatgcagtacaaaacaaggtgctagtgtccatagaggaagaagaaaatataaactatgacatctaagtggcagatgggtggagactggtcccattaacgagaatagggagaactggaagatgatcccattttatgggaaatgtcaagagttcaattgtgattgcttgagtttgagatgcctgtatatatacccgagtgtaatataaaatacataagtgggttaatgagtctggagctcagaaaagaaatttggactggagatgtaagtttggatgcattatacatgatagatcatgttattagagtggatgaaaatatctagggagagaggatgaaatgagaaaaaaattcttatccttcaaactttaaagcatgataataaaaatgttgcactgggaaaggagactgcaaatgaatggacagagaagcaaaaagaaaaggaggagagcctgtgtctcagaagccaggtgagatgttgctactgaagagtcattgattgtgtgacacagccccagaggtttaatcaaatggagtgggacagacagattcactatcttttgttttcctatacttactgtactttcttagtcaatcttgcccaactaaagactttttttcagacaaacaaagctgcacaaattcattgcctatagacctgcagcacaaataatgcaaaggaagttctttaggtggatgatagccaagggtgttccccagagcaatggattacgaaggcccaaggtataaaagtctatattctaccactcagccattaaaaaaagaacaagatcatatcctttgcagggacaaggatggaactggaggccgttatccttagcagactaacacaggaacagaacaccaaatactgcatgttctcacttataagtgggagcttaatgatgggaacacatggacacatagaggagaacaacagacactggggcccaccagagggtggagggtgggaggaggaaaaaattcaggaaaaataattaatgagtactaggcttaatacctgggtgatgaggaaataatctgtacagcaaatccccatgacataggtttacctatttaacaaacctccacatgtactcctaaacttaaaagttttcaaaaagtccacattacatccatgctactctctagtcagaagcagaatacaatataagcataacattctaacttattttttaactttatgtatatatgtatatacataaagatcagtaaattgaattactgttcaagtctcttaggttatcggatcattactgaaggaaaacaaggcattgaaaagtttttggaaacatgagatttgataaatcatggaaaatatataggaaaataccagtcacaaataaatctcataatctatagcctaatattgcttgataatatatataataaaatatattacttataatcagatgtattatttgaagtttgtttaattaattgatatttttatacttgatacaatctattattgagtaattatttaataatctatatataataaaatccatcactacatagaatttgcactaaaattacctgtatgaccaagtcagagtatacaaagggtaaaattatgataaatactgaaattaaattaccttaaatgcctgatgagtttattttttcctctcagcattaagaagttggtaaaaattgatataaaaattagcaaacactttaaaatgtgtcccattttttggcagaacataacccttgtgtttctacacttggctctccttgtgagagataatattttctgaatcattgagacctgacaaaacaaaaggcttcagaaaatctggctaaattcatcagccagtcagtaagtaagcatttattataaaccaattttatgcaagctctgtactagatgtgtacaatacagaagcataaagcatggtgacagcttgcataaagtttatatattaatagtaactaacaactaggagcacttactatatacaagcactatgcttggtacgtttttttcatgttctttcatttaatcagtccttacaatattcccatgacataggcattattattagtagtagtattttcatttgagaaataaatacagtgaggtttaatgagcttaggtaacttggctatggacaaacaataactaagcgtacaatatgacattaaagtccaaagtgtgagaaatgaaagttcatgcttttaacaattaaatatactctctctcccactttacaactaattgggaaggtgatatagtttggttctgtgtccctacctaaatctcaccttgaattgtaatcctttttatccccacgtgtcaagggtgggaccaggtggaggtaattggatcatgggggtggttttcctcatgctgttctcatgacagtgagttctcacgacatctgatggttttataagtgtctggcatttcctctgcttgcaatcactccatcctgccaccctacgaagaaggtgcctacttctcccttgccttctgccatgattgttaagtttcctgaagcctccccagcaatgcagaactgtgagtcaattaaaattttttattttataaattacccagtcttgggtatttcttcgtagtagtgtgagaatggactaatgcagaaggtaaggaagatacatttgaaataatgaataatacaagttaggaggaaaaagtgctctttaattatccttattaaaaaataatattttctactgttaagcaatatttgtgaaattattaaattaaaaaatcagcaggcttcccagacaactgaggttttctcacttttgatagagaagaaaagtgacggcttaatcattgagagtacagacatagatcataccctggaaacaaaaagttagaaaggttaaaggcataaagcgttttcaatatatctggcagtcgtctccacatcagatgaacacatcagccttaacaactagaaaaataggagccagctaagaacattctcaaagagctgaggagaatctccctggagaaagcaaagtgaaaacaacagacttattagaagtaataacagctaatcagtgttctgtgttaggttgagcatgagcaggaatccataacagcagagaattcaagtaggttagggcataggtaggattgtggagataagaaaactttcccacataagaatgagtaagtttggacacaaagtcagagcagaatgtgggtaacagcaggtcaaactagagttttgttttttttttttttaagatagatttgacaagctaggaaggcaaaatcctggaagagacaagtagcacagatttttagagagaataataataataacaaatacccttagccaaaggtttaaagttcaaagtgaaccatttattcagcagcaagcatctcagttctagatggtcaactccatcacggtaaatggtaattcaaaatttaaaaatcagatcatctgacattagcgataacatacattgattcatttatccatgcactcagtaagtatcatttggtaacatctatgtgcctatcacagtgataaacaccaggcctctgataaatgaaagtcaaatgaaacaatatgttctttgctgtagtggaaattgcattatagtggaagagttaggtattaaataaataattataaaattgggttgttaattatagttttgatcagagtaatagagataaggtagaattttgtgagcataaattgaagaaggaagtttcctagtttgcaaagtagtaaagaagatacaacctcaaatatgagactgttagccaagtaaacatttggagaaacagcgctcctgacaaggagcgtaagtttcataatttggaaaagaatagggagattgccagtgtggctggaatgtggtgaaggagggggaaagagaacaagatgaggctagagggttggttaggggccaactggatgttttatgccatattgaagatttaaaatattaatcgtagtgggaaaacacattttgagtccagttggtatgatgacatccacatttttaaaagacactttgaggtattctgatacaatatttggtgtgaattagcaagcaggagtgtgaatacggggaaatcatttataaggctatttcaggagtctaagcaagagatagattatgagggctcgaacttggttattgacaatgaagatcaaaaaaaaaagtagatggaagatggatacaatatataattaggggatagaaaaaggaattgtagctgtaggcatcaaacatgagcagatggtgtaggatgatgccatttactagaaaaggaagaactgaaggaagaccagattttgggaaaatattgagagttcagttatctcagaatgaaataaccaagtagaaatattaagtggatgtgtctacagttaggaaaagatatcttggttggagacagagtttgagttcatcagtatatacatattctataaaagatgacatctataacaggaagacagaaggaaatccaagtttagaaaaagaaaaatgagttgtgtattgcctgaatttgagatgtttgtatgacacccaggtgtaaatattaagtatgaggtaacttcagtatggtcatgaaaaatggacttaaaggtagaaaaaatataaactttatttctcaacacaagttcatcaatgacaagacacttttgtaagcaatgataccagccatttagtccatctctaaagaactaagagtcctgggaatttaatcgtgccagtgcagtcttttttacattattaactgaagaaaaatgagtgccctttacagacttttaagattaggaaacaaaaataaatcagaaggagccaaatcaggaccgtaagatgtatgtctgatgatttcccatcaaaaccctccccaaattatgcttgtttgatgagaaggatgaacaaaaaaagcagtggcatggtgaaagactctatggtgaagatttcccagacacttttctgctaaagctttgcctatcttttcaaaacactctcataaaaagcagatattatcattcttggcactcctgaaagtcagtaagcaaaatgccttgagcatgccagaaactgttgccatgaactttgctcttggccagtctgttttgctttgactagaccacttccaccttgctttgattatctttgtctttgtcttcagtattttactagtaaagccatgtttcgaatcctgtcaaaattgtttggagaaatgctttagagtcttgatcccacttgtttaaaatttccattgaaagctctgctgttatctgcagctgacctgggtgcaatggtttgggtacctgagtggaaattttgctcaactttaatttttcagtcagaattgtgtaagctgaaccaattgatgtatctatcatgttggctactgtttcttctgttaattgtagatctcttcagttagggcatgaacaagatgaatgttttcctcacaaattgatgtggatgttgtgtcactgcaggctttatcttcaacattgtctcatcccttcttaaaatgagttattcatttgtaaactgcccgtttgtggggaggcattgtccctgtaaactttttgaagagcatcagtgatttcaccattcttccacccaagctttaccatgaatttaatgtttaattttgctttaattttagcagaattcaagttgctctgatagggtctcttttcaaactgatgttttatccttcttagtgtctcaaactagatcttgcttagacatgttttaacaagctagtacaactttattttgatgcaaaaataattgaaacccatgcttagattttcacaatatgcatttttgaagacccccttgtatgtaatttggctaagggtctgaatttcagaaaagaaattttggctagacatataagtttgaatttattatatatgatctttcaagttacaagagtagatgagaatatctagggagagaacatgaaggagaagaggagaggggaagagggaagaggagaggaatgatgagaaggatacaggaagggaggagaggagaaggaaggggaaggagaagataggggagataacttttggaccatagatctttgagggaatataaagtgcatccactttaaaggcattaagctgatcttaatacctgatcacttacacgacaacaagctatgattcacttacaattacctaccaagggttactgcatggtggaggtaaaggagtggttgagtgtgctcactaggctaatttatctagttccaaactttactgctactaattgctctagagactactgaatgcggtaatgtgactctcattaaatgaataaaataattccaagtgacttgcacttctagacttttttctggaagttacatagaacaaaagacagatcaggtaaaagcagtgattaggttgtgggctttgaaatttccatctattcctttgaatataacagtaataatattgaagtaggaaaggagtaacatttataaatgttaataaaattcaaaacaaatgttgacaagatatgtgtacataaacagttcacaagccacctgccattttacaaatgctagtcattttatttaataattccataaaattttatttcaggtactattgccatttcgcagttgttgttttgaaaacccttcaagagactgtatgtttgaaaagaaggttgggaaaccagtttaatattccactggtacaagagcagatggttgcctgaccccgtattagactgagggattgcagtcacatgcctctgttaataacaggatgggttgatggatagaggggagggtaagatttaagatgcatcaagagagcagggcttagggtaggaaaggcaaattttaatggattcaggttatagggtcttcagaattttatctcagggtaactggagcacagtggactggctatttttaccattttaagagctctttatatttttttaatgtataggccaaatttctctccagcatcacattcttttggcctaaagaaataattttaatattacttgtaaatcaggtgcattggaaatgcattatctcagtcttttttttcttaatctgaaaactgtctttattttgcctgcatttttgaaagattttcactgcgtatcagattatggattgacagttgtctttattgttactgtcgtttccttcttcaaagatatcactgctgtgtcttctggtgtacacagttactgacaaaaaagtctgactttttaatgtttgttccttggtgcacaatacaattttccatattctcactgcctttaacatatttttaatttttattttcgtcagtgtgactgtgatgtatctatgtgttgtatttgtttattctggtatttataatatttgaggttctctgagcttcttggatatgcggtttagtgtattttcttctttttggaacattttcaataactatcatctcaaaatttcttctacccccttttccctcttttcttctggacttttgcacgactgatatttaccatctgatattgttccagagtccttggaagctctgcactatgtttttctccccatcatttttccttttatgtgtcaatttgggtgatttctattaggctatccttaagttcattgaatgtttcctgagctgtatcaagtgtactggttggtctatcaaagaaattcttaatttctaatattatcttcttaaaaaaaagtctagtacttccatttgactgttacttaaagtttccatcttcctgcttaaattctcactttgttaaggaaggtttcccactgtgccctttatatctgttagcattttaatcgctgatattttaaattctctatctgatagtttcaatatctgagctatctgtgagtttggtttagttggttactttgcttttgaaaatagtttgctgtgtgtgtgtatgtgtgtgtatctcataaatttgaatgctaaacattgtgtatggaacagtagaggctgaggtcaatggtatttatacctgaaaatgagcagtccccttctattgggttgttagtgtgtggaaggagatctgaatttttagttttttcttaccctggctatcttcaatgggacacaggcttcaaatttctctagcgtggcctgatgcttagagagaaggctgggttgctgttgcttgtttgttttctttcctattttttaaatcaatgttgtaatctgctcccagctctccgctgactctatgtgccctttgcacagatgatatctctctccatgttctttactgcactccagaggtagaatgctgttgcttgatactcagtgctaggttatatcggagtgcaaggataacaggctctctattctgctctaatctcagccttaaagagctcctgtgtgtctatgcttcaagagtgcgggtttttcagcatttctgcccctcctccccatgaaggccaagctaccttatatatgcaactggtcttggcagagagtttcccgccaatcctttagcagtaagagatttcaacttgctatttggtattgctatagaagcctagatccagtcctcccccagagagaagtgtggttttatttgtttgtttgtttttaccattcccccagctgtaatgtgtctctttgttctgtggttatgagaccttacccacccgctaatgtcataaagtgtttcttttgtaagaaaggagagttcagggaagtgcatggcatcacatgtctattcctccacagttcccaatcatttcccacccaaatggaccaccagtgggggctctctggtctccttccctaacgccaatcttctttatgagcacttgaaaaatatccttggagcctgcaagtgattaaagcttttctttttgtcagatgtcctgagctatttcagattgacatggtagcccatatggcctctgcagatctttaaaattttagctcattaagtctcaatcacacacatattgtccctagtgtggcacttctttctcccatactccaccactaatgagacagtttgtgtgccctgcttttccttggaggaacttgtccctttttgacttatgggttacatgattaccttgtagtctgagctctctgacaaacaataaaatcattattttctagtttattcagttttttcatagttatggtagaagcaatattctttgcagctttctacatcctaaatgaaggctagttatagaacttttttgactatcagtcatattgatgtagagcagccacactataccaagcacaggaacggtacagaatagtgataattcatacaaaataatcactgattctatacctggagaggaccctaaaggatggatacttaccttgggctgggatcgagaagcataaaatccctggaaatgaaataacatatattccctcctctatagctcttcattcctttctatttcacctcctcacttctgacatatacttgcaagaaaagggggtgtccacatcatataaatggttccctcaattattattattataattattattatttttatacccctcctctttttatccccatccctacatggtgagtagttctctagtctagagagtatggaccagagacttgatcaccaacagagctaacatggtagacatttccaaagagctagcataaggagggcgaaaggtggctctagccttgtctaaaagctagtgctaccctcttcttacatttaagatttctgctgcaccaaaggccaaagcctctcattttcaaggactctggaatagtactgcaagtgctctaaatgtagagtgattagaagatcttagttaattaagacagatacaggttaggagtggacttcattagatccttctcagagcctgtcagaacctcaaaattattttctgttcttatgtttcttcaagtggaatctataattcttatcctactttgttaagccattgtactgtttaaattactgttgtgtatttttaggtaactaccttgtaaacctattcaaccataggaaaaaggcacatttggggttaattttaaatataattacctttaacattttcttttatctcttaatgtcttttaatattattgtcatccaggagggatgggaatttaaataggatggttcaaagcatatttatagctaacttgcatgcctgtgatgaagcaaatttaaccacaatgattttccaaattctttgtttacttagacagtataactgcctttgatagtttcttaattttcttccctcaactgtcaatggtaaaagtacagatcttttggaataagcattccctgggtgttcttttagattcagtcattgttcagttgaccaaagagaacttactatagctcaacttttgcctatccatactggaacattagttaaaattttgagttgactgtgttaaaatcaaaatttaaaaacactatgttttggggttagttacggttaattatctttaaatctctcaagtcattgaattgtgagctgagatgtgctggtaaatgtgtaacaactgactctcccagggaaaagagaaaaccctaatgtgcagcatttgctgattttggtcatataaatatttccaccatggttgattccaagctaccaacatgatgtcatcgaacatcatataattgggaagaagtactcaatagcacactattatacagaatttccaccatacagataaaataggtgtaaataatctctatagcattaataatattaaaatgtataggaatgatttagagtatttagcattttaaaaatataatttaaagcttatcatttaattattaatgatgactgtgatttttttaaacaaccagcttgcaaaattcctgaaattaaaataggctcttccatattgtgacaggctgatctcaacaaaccactggttctaagcctttgaggacaagagcttttaaattccaaccaccagattgggttttgactcacagcccacatcagtgaatatttgcgaaagaaagagctcaagtcaaggttagccaataaaaacaaacgaacaaataaacaaacaaacaaaaacctaggtattattctttgaattcatacatctgcatggtccaaactggtttttctttcacttccattcccttgtttttctctgtgcatgtaatttagattatttttcaaacataattattactggatcatatagtggtcactctagtcaagaattttgcatctgacgatttttcaccaagaaggcagtctagatcatgtgttattcacataaattaggaattttattacctactttaaatcaattatttctaattgaaatattgtgtatttctatataaagtaacactttgttcagaaagatccctacaaccattccctagaactaaaatattagttgtattttcaagatatttttatgacttcctctttaatttcataggacagatgtctgtgataaaatcttttccaggaaattacagctgctagtttcaagataaaactccttatgaagaagcaaagttgattgattaccttatgcaataactccacaaaatgaatgttttacaaaataacttgctggtacattaatatccttctctgggggttagtttggggcaggaaataaaatgtgtcccaaagtatgcatatcaaaaggaacttatacaaaatcatcttattaaatgaatcaacaaattttatatcttgaacctatagtcaagtaagaatggaaagaatatatatatataaaacatttattggccgggcacagtggctcacgcctgtaagcccagcactttgggaggccaaggcaggcggatcacgaggtcaggagttcaagatcagcctgaccagcatgacctgtctctactaaaaatataaaattagccaggtgtggtggtgcacgcctgtaatcccagctactcaggaggctgaggcaggagaattgcttgaacccggggggcagaggttgcagtgagccgagattgtgccactgcactccagcctgggcaacagagtgagactctgtctcacacacacacacacacacacacacacacacacacaaaagtcaaaactcatttgtaaatgactctatatatttggagaattttacaactctacagattgtttttaataaaaatcaggtgacactaatctctattgttagtcgtcaggatagtggctatctttggggctggtagaggatggatcagtgtgcattattagtgtgaacaatatatacttgtatgctgtaatcatggtatggttattttaaaaaatatatgcaaaagtttttagataagtacctttttaatgataatgaggctgaaagtccataaatgaagcctgtattttaaatcaagtattgtagcgaattttgtttggggcatttattcattcatgcattcctataataagccctcttttatattcttcagctttgttgaggtatacttgacaaataaaaattttatgtattaaaggtgtatatgagtcacaaagtgatgttttgatatctatatacaaattgctaaatgatttccacaataaagtttgttaacatagccatcatctcacatagctaccttttgtcctttttgtgctgacaatacttaagatctactttctaagagaatttcaagtgtataatatggcattattaactatagtcaccatgttttacgtgaggtctctagaacttattcatcttacaactgccacgtttgtaccctttgaccaacatctccccatttccaccacaccctaacatctagtacctaaccttctattctgtttctatgagattgattttttttttttttagatttcacatataagtgagattacatagtatttatctttctgtgtatgacacttcagttagcataatgttctccaggttcatcctagttgttgcaaatgacaggatttccttccttttaaaaattgagctggaatagtggctcatgcctataatttcagacctttgggaggctaagactgcaggattgcttgagggcaagagtttgaaaccagctaggcaacatagtaagacctcatatctaccaaatataaataaataaataaagtagctaggcatggtggtacatgactgctgaggcaggaagatcacttgaccccagaagtttgaggttacaatcagctacaaccatggcactgtactccagcctgggtgacagaatgaaagcctgtctctaaaaataaataacaaataaaaattgattaatatttaattgcgtgtacatcaaatttctttatccgttcattcatcaatggacacttaggttgtgttcattacttggttattgagaataatgctgcagtgaacatggaagtacagatatttcttcaagacagtgattaaattttctttggatatacaccctgaaatcggattgcttgataatatggtcattctgtttttaatttttttagtatcatccataatgtattacataaccctttgctggtattttatacaggcaacacaatatgccttttgaaaacactgagttgaggatatttgcatctatgtttatcagaattggcctgtaattttcttttcttgtagtgtgtttatctggctttggtataaggataaagctggcctcattaaaatgagtttgaaaatgttcacttctctataatttttcaagctgtttgagaaagattggtgtaaattcttttctaaatgtttggtagaattcaccagtaaagtcatccatttctgggctttttttgatagaagatttttgataactgattagattgccttacttgtatttgtctgtttagattttctatttcataattcaatcttgataggttgtatgcttctaggaatttattgatttcttctagattatccaatttgtttggatataattgttcatagtagcctcttagaatcctttgtgttttgtaatatcacctgttatatcctttttcatttctcattttatttgagtcttttctcctttttccttcgtctcactgaaggtttgttaactttatcttttcaaaaaaaaaaaaactcttagtgtcattgacattttctattgtttttccattttctatttcacttatttctgctctgattttgttattttgtttcttctactaattttagtcttagtttgttcttctttttctcattccttgagatgtaatgttaggttgtttatgtgagatctttcttttttttttaatgtagacatttattgccataactgtctccttagaactgcttttgctgcatcccttaaatttcggtatgttgtgttttcatttttgtttgtcttaagatattttcaaagttatcttttgatttctttgactcattggttattcaggagcatattgtttaatttccacatgtttgtgaattttccagtctttctgttattattgacttctagatttgattataaaagatacttaatatgatttcaagcttcttaaatttgctaagactgattttgtggcccaatgtttgatctatcctagagaatgctgtgtgtacacttgagaagaatatgtattctgctgctgttggatggaatgttctgtgtatgtcttgtgttcactttgtctataggttatttaagaaacctatagacaatgtttctgtttatgtctgctgttttcttactgattttctgtctggatgatttatccattgttgaaaatggggtattgaagcccctaatactattgtatttgtgttgatttctcccatcagttctgttaatatttgttttatatatttagctgctatagtattgggtgcatatatatttacaatggttatatcttgatgaattcactcttttatcatgatataatgacctttgtctcttacgacagtattttacttaaagtctattttgtaaaagaccattttgtatatttagggttccatttgcatggaatatcttcttacatcccttcactttgtatgtgcccttaaagctctagtgagtctcttgtaggtagcatctagttaggtcttatttttctgttcatttgtctgttttaatccattaagctactctgtatcttttgttgagagaatttaatccatttgcattcaaggtaattattttaggtaaggacttaatactgccagtttgttaattttttttttttttttggttgttttgaaaatcaattccttccttccttccatcctttttccttccttccatcctttctttctttctctttctttcctttctttctttctttctttcttccttccttccttccttccttccttcctttctttctctttctttttttctttctttctttccttctttctttctttctttttctttctgccttcccctcctttcttttcattttttgctgtctccatttttgacacaataatttcagttttttcttatttgcttctaaaaagaaaaaaaaaaaacaggattcatgtgcagaacatgcagatttgttacataagtatacatgtgtcatggtggtttgctacacctattgacccatcctctaagttccctcccctcaacccccaacccacaacaggccagggtatgtgttgttcccctctttgtgtccacgtgttctcaatgttcaactccttcttatgagtgagaacatgcagtgtttagttttctgttcctgggttagtttggtgagatcgatgccttccaacctcatccgtctccctgcaaaggacacgatctcattcctttttatgtctgcatagtattctatgttgtatatgtaccacattttctttattcagtctatcattggtgggcatttgggtgggttccaagtctttgctattgtaaatagtgctgcaataaacatacatttgcatgtgtctttataatagaatcatttatattcctttgggtatatacccagtaatgggattgctgggtcaaatggtatttctggttctagatccttgaggaatcaccatactgtcttccacaatggttgaactaatttacattcccaccaacagtgtaaaaatatttctatttctccacagcctcgccagcatctattatgtcctgacattttaataatggccattctgactggtgtgagatggtatctcattgtggttttgatttgcatttctctgaggatcagtggtgttcagctttttttcatatgtttgttggccgtgtaaatgtcttttttttgagaagtgtctgttcatatcatttgcccactttttgatggtgctgtttgtctttttcttgtaaatacgtttaagttccctataaattctggatattagacctttgtcagatgggtagattgcaaaaattttctcccattctgtagtttgcctcctcactctgatgatagcttcttttgctgtgcagaagctctttagtttaattagatcccatttgtcaattttggcttttgttgcaattacttttggagtttttgtcataaagtctttgcccatgcctatgtcctaaatggtattacctaggttttcttctagggtttttatggttttgtgttttacatttgagtctttaagccatcttgagttaatttttgtataagacgtaaggacggagtccagttccattttttctccatatggttagccagttttcccagccatttactgaataggagatcctttccccattgattatttttgtcaggtttgtcaaagatcagatggttgtagatgtgtgctgttatttctgaggtctctattctgctccattggtctatatgattgttttggtactagtatcatgctgttttggttactgtaggcttgtagtatagtttgaagtcaggtagcgtgatgccttcagctttgttcttttggcttaggaatgtcttggcaatgcaggctcttttttggttccatatgaactttaaagtagttttttttccagttctgtgaagaaagtcattggtagcttgatggggatggcattgaatctataaattaccttgggcatatggacattttcacgatattgattctgcctatccatgagcatggaatgttattccattcgtttgtgtcctcttttatttcgttgagcagcagtttgtagctgtcctcgaaaaggtccttcccatcccttgtaagttggattcctaggttgattttctttgaagcaattgtgaatgggagttcactcatgatttggctctctgttggtctgttatttgtgtctacccttgtgacacagtgaaagagaaacccagttactgtagccttgtagtatagtttgaagtcaggtggcatcatacctccagctctgttctttttgcttaggattgtcttggctatttgaggtcttcttagattccatatgaaatttaaaatagtatttttctaattctgtgaagaatgtcaatggtagtttgatgggaatagcattgaatctataaattattttggatagtatggccattttcacaatattgattcttcctatccatgaggatggaatatttttccatttgtttgtgttctctcatttgcttgagcagtggtttgtagttctccttgaagaggtccttcacatcccttgttagctgtattcctaggtattttattctttttgtagcaattgtgaatgggatttcattcataatttggctgtctgcttgcctattgtaggtgtaaaggaatgcttgtgatttttgcacattgattttgtatcctgagactttgctgaagttgtttattagtttaggaagtctttgggctgagatgatggggttttcaaactataaaatcatgtcatctacaaacagagacaacttgacttcctctattcctatttggacaccccttatttctttctgttacctgattgccctggccagaacttccaattctatgttgaataggaatggtgagaaagggcatccttgtcttgtaccagttttcaaagggaatgcttccagcttttgtccattctacatgacattgtctgtaggtttgtcataaatagctctaattattttgagatatgttccattaatacttagtttattgagagattttaacatgaagcgatgttgaattttatcaaaggcctttattgcatctattgagataatcttgtggtttttgtctttggttctgtttatgtgatggattatgtttattgatttgtgtatgttgaaccagccttgcatcccagggttaaagctgacttggtcatggtggatacgttttttggtgtgctgctggattcagctagccagtattttattgaaggtttttgcattgatgttcatcagggatactggcctgacattttctttttttgttgtgtctcttcctgcttttggtatcaggatgatgctggcttcataaaatgagttagggaggagtccctccttttcaattgtttggaatagtttcagaaggaatggtactagctcctccttgtatttctggtagaattcagctgtgaatccatctggtcctgggctttttttggttggtaggctattaattactgcctcaatttcagagcttgttattggtctattcagggattcaaattcttcctggtttagtcctgatacggtgtacatgtccaggaatttatccattttttctagattttccagtttatttgcatagaggtgtttttattattctctgacggtagtttgtatttctgtggggtcgatggtgatgtcccctttaccactttttattgtgtctatttgattcttctctctcttcttctctattaatctagcttgttatttatttatttttttcaaaaaaacatcccctgaattcattgatttttttgaagggtttttcgtgtctctgtttccttcacttcttctctgatcttatttatttcttgtcttctggcagcttttggattcttttgctcttgcctctctagctcttttaattgtaatattagagattgatttgagatccttttagctttctgatgtgggcatttagtgctataaatttccctcttaacactgccatagctgtgtcccagagattctggtacattgtctctttgttctcattggtttcaaataacttcttgatttctgccttaatttatttcattatttaccctggagtcattcaggagcaggttgttcaactcccatgaaattgtgtagttttgtgtgagtttcttaatcctgggttctaatttgattgcactgtggtttgcaagactgttcgttatgatttccattattttgcatttgctgaggagtgttttactttcaattatgtggtcgattttagaataagtgccatgtggcactgagaaaaatgtatattctgttgatttggagtagggagatccatagatgtctactaggtccccttgatccagagctgagttcaagtcctgaatatccttgttaattttctctctcattgatctgcctaatgctgacagtggggtgttaaagtctcacactattattgtgtggtagtctaagtctctttgtaggtctctaagaacttgttttatgaatcttagtgctcctctattgggtgcatatatattcagaatagttagctcttcttgttgaattgttccctttaccatcatgcaatacccttctttgtctttttagctctttgttggtttaaagccggttttgtcagagactaggattgcaacccctgcttttttttttttttttttttttttttgcttttcatttccttggtaaattttcctccatccctttcttttgagactgtgtgtgtctttgcatgtaagatgggtctcctgaatacagcacattgatgggtcttgactccttatccagtttgccagtctgtgtattttaattgaggcatttagcccatttacattttaggttaatattgttatgtgcgagtttgatcctatcatcatgatgctatttggctattttgcacactagttgatgtaatttctttgtagtgtcattggtctttatgttttggtgtgtttttgcagtggctggtactggtttttccttttagtatttaatgcttttttcaggagctcttgcagggcaggcctggtggtgacaaaatccctcagcatttgcttgtctggaaaggattttatttttcctttgcttctgaagcttagtttggctggatatgaaattctgggttgaaaattctttcctttaaggttgaatattggccccccatctcttctggcttgtagactttcttctgagaggtctgttgttattctaatgggcttccctttgtaggtgacctggcgtttctttctggttgcacttaacagtttttccttcattttgacgttggagaatctgatgattatgtgtcttagggttgatcttctcatggagtgtcatcttaatggcattctctgtatttcctgaatttgcatgttggactgtctttctaggttggggaagttctcctggataatatactgaagtgtgttttccagcttgattccatcctccccatctccttctggttgtccaatcaattgtaggttcagtttttttatgaagttccatatttcttggaggctttgttcattccttttcattctttttttctctattcttgtccgcatgttttatttcagtaaggtggtcttcaaactctgatatcctttcttccgctttgtcaattcttctgtttttacttgtgtatgcatcacgaagtactcgtgctgtgtttttcagctccatcatgtaatttatattcctctctaaactggatattctagttagtaatttctctaaccttttatcaaggttcttagcttctttgcattgggttagaacatgctcctttagctcatcatagttttttattacccatcttctgaagcctacttcagtcaattcatccatctgatcctccatccagttctgtgcccttgatggaaagatgctgcaattatttgggggagaggaggcactctggcctttttggttttcagcattttttcattaattctttttcatctttgtgagtttgtctagttttggtatttgaggctgctgacctttggatggggtttttctgggggcctttttgtttttgttgttgatgctatttttgtcactttgtccttgtttgttttctttcaatagtcaggtccctcttccatagggctgctgcagtttgccgggggttcgcttcaggccttattcatctgattcactcctgtgcctgcagatatgattcaaggaggctgaagagcagcaaagatgggtgcctgctccttcttctgggacctctgcccttgagggggactaagctgatgttagtaggatcgctcctgtatagggtgtgtctgacaaccccggttggagggtctcactcagttgggtggcacaggaagcaggacctgtttaaggaagcactttatcccttggtggaaagggtgtgttttgctggggggaagcccacttctctgggctgcccagagtcttcagaatgaccaggaggagaggctaagtctgctggtccccagagactgcggccacccctctcactaggggctcagatccagggagctctgaattctgtccctgagcctctggctggacttattggaaatcctgtaggaaagccccacccactgaggaaggatgcctcagggttagacctgaagaggcactctggccgtattccacagcaagtgtgctgtgctgtggggccaagtcttgggaccaagctatccagtcttcctggctccagcaagggaaaagcacagcctggagctatggaaataggtgccgcccttccccccgcccagggagcttagcatgttaggcattgtaggtcccagtgctggctgctgttcctccctcaaggagctcaaatggcttagacagcaggcagctgcagccagtgctggtcgcccctcccccctggagttcagtaagcttaagcagattccagctgagaggctgtaagaatctgcacgttctgggattgggacactaggctctggtggtgtgggttcacaagtaggatcttccgatccgtgggttgcacatttctgtggaaaaaggacagtttacccagctgggtatcgtgctcactcaccacctctcttggctcgggggagggggttccccttccttgtgtcgttctcaggttggctgccgcaccacactgttctttcttctctccgtgggtcatgccagccttctagtcaattttgatgagagaacctggataccttggttgccagtgaaggattcacatgcttattatgtttttataagaagcatggcactagcagctgcatctggtaaaggcctcagaatactttcagtcatggcagaaggcaaaggggaaccagcatgtgcagagatgacatggtaagagaggaagaaagagagagggtgaggaagtaccaggctctttttaacaaccagctcttgtgggaactaattcactcacctctgatggagggcattactctattcctgaggtatccatccccatgacccagacacctcccattaagttccacactgccacattggggatcaaatttcaatgtaaggttcagaggggacaaatattcaaaccatagcagtggctctgattctgaggtgtggacacatgtggagtggcagtgaagtcagagtccagaatacagttgtgtagagtgactataggacctggagtgtaggtaactctcagggactctgactctggtgtctgagacatgggcacttacagtggaatcatagagccagtggtctggaacatgggtacaagtggagtggtcatgattctagagtttggtggggtttgggaggtagcatcacaataataattcctttttagggggatcacagcatctccctctccaggttgttcacagtggcaatggctcttggtgacctcagtggtgaaagttaccagtgtcccttgcagagaagattcacgggaaaccatgttggcacctgatgcatggctaatactgatagcccccaccattctagacatctctagatatctcaggtgtgccattcttcccagtgatttattgtgtgattattctgggcattttgtttatttattgtttgttttgtttcattttgttgcatagattcttttgaacctttgagcaatcccaaggatgtttttcttgcctttgtagggaaaataaggctgatgtctccatctctgtcaacttgatgacgtcactccacattaaatcttcctaaaggaattacttactgtttgattcgtagttctcagaagctcaaaagttctaaaataaccaagagtgtacacatatttcttgaataaataatttgagacataatgagacaggtctaattgtcttgagactggaaatgtgtttaggctaaattatttttcaaatatttaaatgtgttactagagaagctaagtaggatgtaattttaaaagctcttccttaatatgtatccagagagacagattggcaggtatccaaagctatttggtgactctcatggggcagaacttgttgctgagatttcttgatttaaatatgagttgaatatgccttcctccaggagcatttagtcacttaaaaagaaaaactgcctattttaaagtaactaaaattaaatatgattaaatagagattattagaattacttgttatactttgataaacttaaaagactttatgtttttcaattatacttgtaaccattagtagtagtattagtggtctcattttacatggagattaaattgcaattagctcattttcatgaaacctgggaaatgatttggtatatggatatttgaaaactatttgaaacattaggggaaatcttgggcattttaatggaaccagaaatcctttaatgttacataaaccatgtacaagtatctcaaattttgaaacatgttaggatacctgttcactatagatatttatttttaatttttttctttaattgaatctctttcttaatgattggagagatgcttcaaatagaattggatgacattagaagtattttttttctcctggttaccatcttaaaagggaaatagaaactgaagaaaggggactccagctataaaaccaagggagctggctttattatattttcctcacttttaaaatatattattgatatttcaagcatttagatagtattcaaaaacaaaatcaaaatttgtgttccactaccagcttaataaatagtactatgtgcaattgaaatcttctgtgaatttctttctggtaataccctcctctgctccccagaagtaactatgatcctgaatttgatatttatatacttctcaatgttttttataatttccagtctagacaaaatataaatcttttttttttttttttttttttttgaggcagagtctcactctgtcacctaggctggagtgcaatggcatgatctcagctcactgcaacccccacctcccaggttcaagcaattctcctgcctcagcctcctgagtagctgggattacaggtgcccgacaccatgcccggctaatttttgtacctttagtagagatggggtttcaccatgttggccaggctggtctcaaactcctgacctcaggtgatccgctcgcctcgggctcccaaagtgctgggaaaaaatattattatactatcttgcttgtttttacatgttatgattggaattgtgatgtatgagttcttctgtacattttcttcctcaacattaagcttgtaggctctatgttgatacttgtagctctattgtattatttctgagtgaatttttaaaaatgctattaaagtgtgatataacgtaataaacatggctttttgtcatatggaactcaaattctgtcttattccttatatctatgtacctttaagaaagttatttaaatgatctcagccagctttaaaaaaaatctatagaataaggtaatagcatcttcttttttcttccaaattttattttagaaccaggggctacatggacaggtttattacaaaagtatactgcttgatactgaggtttggagtatgattgaatccatcacccaggtaatgagcatgatacctaacaggtagtttttctgactcctacccacttctccctgtccctcttatattctctggtgtttgttgttaccatctttatgtccacgtgtacccaatgtttagctcccacttataattgagaatatagcatattctttataaagtagtcttggtataatgatgtaatgggggtatatatttaaacacatatatgtatgtatgtatacacacaaacatatccacacatatatacaataatatattttagtaacataataacaaatattaattcttttccatattataattttcttttctatctctactttttaaaattagttgtgattactataaatactttttatataacagggactacttgttggtattctgggatataagaatgcaaggaaaaaaatttgagaaaaaacattctgttatgtctgtggttctcagcagcttgatgcagtgaaagaggcctgagctatgaagtcataaatcctggatgtgacttccagctcattggttcacggttgtatgacttgaccaaattacttaattttcttttagcctgatttttcattggcaaaatggaaatagatgctacttaactaataagggctttgtgatgatcaaattaaatcagtttagtaaagtactaaacatttttccaggcttactgtatatgtgtaatgcaaattagcaattgtatatgcaattgtatatgtgtaatgcaaatttaccatcaatttattaatatgtcaaatattaacagaagtcttttgtatatgtttacttatccacatttcagggctttattttccatcttcttttcactttacactttcaaaccctgagttatttcatggacttccatagcttaagcagttctggacactaacaaaccaatgtattcaactacagactcattatccaatagattattggaaattttatgtgcctaactcttcatcttcctagtttacctctcctttgttaaatctaaaattattttctcattatctcaccatattcttgtaatacttagtactactactctagtgtttaaatatctctaaaatattttcctcatcaccatatccttacatttgccttgtttagtgcctcatcacttctggtggattagaaatgatattttattaaatgtatcccttgcccctgcttatggcatccagtctatcattcccctacaaaatctggccatattactctcttggtgaaatcttgaaatatttatatttctgcagaatagcatcaaacatcttaacagcgttgaaattgtcctatataatcaatattttaacagtttttaaaaggtctatataaatcagattctatataattttgccgtatcacctgataaattgtccattgcatccaaagttctcatcatagagaaacttgagtttctcaaagcttatcatgtaatgtcctccctccctaaaaatgcatgtgttgttctctttcctggaaatgccttcaagccttttcttccaacactaagccttgagaggaaataaattaatgtttctaaagtccttactgtatcagaaactgtgttaagtaatgtaaagacatggtaatagttgaatttcctaataactctatgaggttgacaatatctcaattttagagatgaagaaattgaggcaggatttaaactctcattggctgactccaaaaactgtattgttaacaattgtgccctaaataatttatttaattcccacaaaaacctaaagaaagatagatatttaagttgatttttacgcgataaaactgatgctcttgtagtacaaatggtgtatcctagtcatatagttaaattcagcaaagcctaaatttaatatcaaatttgacaaacattaaagcccatattgtttccattataaacccctgtgtctttaaatatcaccccttccctcaatgaatcatttcccaatgctcccatgggtaaatgataatgccaatgtttcttctgctgatatgcctcgcatagtggaataaaataagaataattaacatttatctagcagttattttacatatagacacagttctatgtgatttagttaattatctaatttaaatatctcaatgagtatcatagcgaccgtgtgcattactctccaacagtgtggtggcctgttttccttatgcaagtgtgaacaccttggaggcaacaactgactgatacatatttgacttcctagcatctagtgcaattccttgtgtgtagaaggtacacaataaatatttttaattaaatgaatgggctatgttagagagtgtctatgatattggtaggacacagagagaaaagtagaaagcatgccttaaatcttagagaacaaataaaatcttctcccacagtacttatcccttgaactcaggaatgcagaatctttggtaggatgcattcttttcctaacttgtcatggcattttttttttatgttggagacaaattatgcattttccaaatgacagtagtcagttagacatcttaatagagataacagatttatacccaaattggctttgatttatacccaaattttgatttatcttattgaccccattcatattatagagttcactccttattttacatgcactataaaattcaaaatattggaaagcctcttgatctgcaaagacatcacatttgtctaaagtggccatctctgttttccatccatttggaaagatcgtttaagtgtttttctcaggcatagccagacttctgaaaaatggaaattggctctttattacgaccttgtctttgttttatgtgagagtacaattgtctacttttcctccatcatttccattcaatgcttacttgctgcatcttttctttgatttccccaggatttactatctccacagtgtcccttgtgccatatatttctctactttgctgggttctaattttcgtctgttctaggatgatgacaatgatgatgataatgatgaaatgctgatgatgatgtgtgtatgtgtgtctttgtgtgtttctcatctctgtctccatctttagacaattgaatcctgaaacttaaccaagcagatgcaaagttgcagtctttgtttcagagttggctatggagatttgtatgtgagaaacgatattggctttccttccactcactgaagaaagagggactaagctaatgctcttcccagccacctggttatgcactgttgaatcatgccattttaggaaactgaaatttctaattcttacatttgtaattatcgtaggttttgtcaataatttagatttcctaaattattgtactctatataaccttgtacctaataaatttcaaaatattcaaatttctatttataaataaaatgatctttttatatgaaattgattctatatatgattaaattgataaaacttctgtgatttttcaaaaagtctgaggcctttaaatcttctatttaaggaataaataatattactcatagaagagagaaatattataaaacaaagtgtatgtagtttacttgaagtttattagcttggtgacaatacctgcaaatatgaaaatagaagctacccggggcagaacaaaacattgtggcacatggaatacataatagacaaaggaattgtatggccaatttctcagacagccatttggaatgttttagcatctttatcagtcaagtgcaactgtcttctctatggctcagcagggattatacttcacatgcacttcaacatctctgaagtctgcacctattgtcatcagcacccctactaccttcaagggctgatatcaactgctattgatttgttgatgaaaatgaccatgatgacaccaccaagggtgaacacctccctacagcataattatcaattggcaaactttggtttaactctgacagttatcctgtactctaaccctgagtaatgaacttgaaggtttcactttgattttacaaatgatcaggtggaatgacatagaaatatgaattgtgtgtgtgtgtgcatgtatgtgagagagtgtataaaaagaggctttgggaagacatgactttagtcatctcagtgaccttaataacatcatgttcagtccacttttggtggaaaaataaggcttaattgatttttatatctaagacactttgaaaaatagacaagcattttatacatatatgtatttgctggtttacatgaatctcccatcctagtatttttgcaaatactgttacgacattttaaaatgctacctttgttttcccttgatgaatattagcaaaattaaatgtacattttgttttaaagcctgtttttttttttcaggcaatgaaaacaatgctgtgttcttagaagcttaaattctaagagcaagagctctcagaaccactgacacacccagagtaaaggtgcttatgttccaaaataattaatattgatgaacacttgtacccatattgatgatttttaagagaaactccttccacatttttgaaatgaaaaattaattatttgtaaattaaacttttctaaaaaaggttattcaaatgagtcctggtaaaaatctccatattttatagccacatattttctctttctttcatttatttatttattttcttaattttcatttagccttgttgatgttccagaaatgatagcgaaaagccaattccttatatctcacttataatgtaaaatatcagcctaaacttgcagaaagtatatcttttgaataaaagacagcagatgctgtagcatttctgccaaagaaagagtccagtataaacattctgcagtatgcaaatgtcatctcctctatgtgaatattttccccgagtggatgttgcagggttggaggcttctgcctatgatttaggttgtaattttatttgtggaaataaaccaatcgtggagctccaattgtcttggtggtgaggtgatcaatagcccattactggatagaacagcgactacaggaagagcattgaagattttaatgcatgaattatgcatgcagcgctcattctttagtctccgaacagaatgacagggtttgtgaagtcgcctcagatagtttcttgcattaagtgactgcagtgaaatgcttaatattttcaggcatagaagcagcattgactcgggccagccgaatttggaagatgtaaatctcccagctcacagcacggaatgctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtaagtccaaggttttttttataggttaggtaattgtaaactagaatatgctgagttaggataatggtgatgcgatattaataaggttgactcagaccttagtattgcaatgccagcatcaggactctcaattgttacgttaaacgagaggtgactttctatatttgatagtattggaccatagggtattttatcttgcatgcaaaagctttccaagaatgtactagagctcgaatgtgtagaagactgcaaactggggaggggcagcagtagaatgagctgaatcaataagtggaaattacctccttgtggggaagttttagcacggctgtggcatcgcgttggctcagattatttccttaatgtcaacattttcaaattctagtaaaagatgtgggtagacaccagaaatgctcaatccttctcccagaagcagaggaaagcaccgaggtactcaaactcaaatactgtgttgcatacaaattgagcagatggaattaaaacaatttggactagcatgtccttgagggaagaccttgctgtcaaacaaaccatttgacttctacctgtgctggtttggttttgtttttccctcttgttaagaatgccttactccaaaatgtatggatagatgacgtgttgtgacatttacccaaaaaagagttttatttcttgtttttttaaaaattacccctatacaattataggacccactacataagatccaaataaaatttacaaaaactctgtaaaactgaaaaacacagtactatacgagtatatttgtcagaagtcattgttaattaaagtttcttgcttaaatatcatggcaaatgattaattcctgaacatttctttaggatgagaaaacagaattaataaatataaagcaagagacactagataagtaaaattctttaaggctacttttcaatttatattattagtgaacatatattactagtgaatatatatactagtgaatttatattactagtgaatatatatgcacacacatacatatatactataattcatagtttataaaacataatatatgcactataatatataggtatatctacttcctcatgtatgtttattaatactgtttttaaaagtgtgtttgctaaatcatctatcaagaccaagaatagataaggacaagtatgttttgggaaaaaaaagtatcactttattttttttaaaaagaaagaaatttagagtaatgatgataataagagcacagcataaaatgctacattttatgcatttcaattctgctacaatgttgctatattatttggatttcctgttgtccaggtgttgtgcacagaactcccagcattacagaatggtttaaatcttcaaagctgatctagtttaggtataagaggaaactcacacctgaagtttttccttagggaggggaaaaaaggaaggagatattactacctatatatcttagaagtctcctgatgctgagtcatggtgttcagttctgctgaaatgcctcctggctgaggtggctgattaacagctaataaaatggaatctagaggaaaatgagaaagaatggaggggggcagaaacttaaagatatttattgcctaatgacacacactaaattctgagtaataagtagaatggcagtgctacttgttggatctggctgagttgacagtaggagaataaaagctcccgtgctgggtgacaagatcatagcagtagaattaatggcctaacaaggggagagtgtataaacaaagggattcaagaagcactgcccttgtacttatctaaacctctctgtcttctttctagtctcaacccaagccattagccaatctcatttaaaagacataatgttcagataaagaatagtttccagatcacgtaaggaaaatctagaataagatgtgctcagttcctgcttcccacggtggttataattaatttttataggctatcaattgggaggaaccaacaaaaaattgatgagaatttttaaatatcttgtttggtatatatgaggcaccaaaatgagtttagatagtgattattatggcaacatataatcgtattagatataattggaaatggagactgaatatattacaaaaatatatattaaaaaggaaacagggcaaatggaatgagagagtagtgaaacatcaaacataagattttgaaagaaaaatgtacttaaactgtagttgatatacattattagtgactcaaaatcaatgtataaaaaattctgaagtaacaggtttactaatataagggtttataatttctttaaaaataaattttaagggtgacttagagtgagaaataattgacaataatattttaaagtagaaaggtgtaatatttctttatagggaataaatactgatagagctaaaatatatttgtacttatgttgtaataaattgaagtagaaatctctctatatatattgagagagagggagaaagtatagtgtatatatatatatatatatatatatatatatatatatatatatactctttatctgtctacctaactatctagttttctacttagtaactactataagtgatctgtaactaccataatcctaagtggtagttacatatacatatacatatatatatatatatatatatatatacacacacacacacacactatatatgaaacatatatactataagttaatatatagtatagtatatatatttacagtatatatactataaatatatacaatacagtatatatactatacatatactatatatactatacatatatagtatactatatatactgtaaatatctatagtatatatactataaatatatactgtaaatgtatagtatatatatttacttatagtatatacatttacacatataattaaatgtatatactatatttacttaggattgtggtagttacagattacttatggatgattaggaggcctacaagtatttgaaaagaggtaatatacccattttcaacaaagcaagctaatatgaaaattgaggaaatcagagcttatgtttagacaacaagaaaatttcccatagggcacttcagtaaacagtcctgatgagttgcaagctttgtgaaattcacagaaaacttttgcaagtatgaatctacaacaaagagtgattgttgggagatatcatcttcttttctctcctattcgagaaaaatgattaaattggttccccctcaaaatgttttccctgagtaattaacatatgaaacatctttctttcagatatgctcttaagggttgactctgaggagtgcctcagtttaatatagctttatggatgcttcaccaatttattccctcttattgtaaatataccttttactccattttcattgttcatcaatctctttcttctcacaagacaactcagtgcaataaggaagcatttattgagaatcctcttgtttggttttgctaggtactctggttttgtagatgcaaaagatgaagggcctgtgctttcaatgggaacaaacaagtcaaatgcagggggaaaaagataaaacataggagcacccaaaaatatttggtaaaacgttctactgtcataggagaaatgaggaattatgcacaacattttttaaatggcacctggaggaagaatatgtataaaagtatggaggctaaaattaatagtatatattttaatgttggtactgaaacagagggattggatgggtggtgtagttgagaataaacaaggtggggcaggttattaggaacttagccaccagaataacatgtttagacttgacttaataggcagtgaacacccacagacattgtttaatctcactggaggcatttaatgataaagaagtatctgactcctgaatcagataaattctcagcatttctttttaatggctgctaattctaaattaaatagtcatgcaccacataaatattttttgattgcatatttgacagtggtcccatgagattataatggagcagaaaatttcctgttgcgtagtgatatggtagcccttgtaatgacatagagcaacacattaccttttttctatgtttagatacacaaatacttaccattgtgttatacttgcctacagtattcagtacggtaacatgctgttcatgtttgcagccgaggaacaataggctatgccatatagcctacgtatgaagtaggctagaccatctaggtttgcgttaagtacacttcgtgatgttcccacagtcaaaatcacctaactgctcatttctcagaatgtatcctcatagttaagtgatgcataactgtattgtattaaccatgtcttttattttctgaattctgatactttagctttgcagaccctggaaggaccacccttcctaggtgttagctgattactggagttagtatacaacttgcccctgagtacatttttcaaatgcaaaccaaccaatccagagccccactactacaaccaccttccttatctgggctctcacactctgggccactatccacttggctaatcaccccggggacacataccagacaagtgacaaatgaaatttttcaaactagccaatcctaagcacttacctgctcctgttcgttctggtgaaaaccacacagttccccctctctccctctgcctcctgaccagccccagttcttctccatgttgctccttgtggtgtgctgtgctctctgctctggtgatctgtgggtttaacaagttatcttttttttttgagatggagtttcattctgtcgcccaggctggagtccagtggcgcagtctcggctcacggcaacctcctggagtgcaatggtgcaatctcggctcactgcaacctccacctcccaagttcaagcgactcttctgcctcggcctcccgagtagctgggattacaggcatgtgcctccacatctggctaatttttgtattttttagtagagacagggtttcaccatgttggccaggctggtcttgaactcctggcctcagatgatctgcccaccccagcctcccaaagtgctgagattacaggcgtgaggcactgcacctggccaacaagttgtcttttcaatgacagttgtctccagatctgttgtctttaacaaacctaaataataaaacctacattaaaataaacatttaaaaattttctaaattttaatacaaactaacataaatagaaatattatattcccaggacatgaaataaattagccaagtcttttttcttaaaaaaaaaaatcattacctttttactaaactgttatcttattttgaatttaaggatcaattctgaatgaatctcctataaaaataagcttaactattttccaagttgtggttgataaagggagggtatatcctctagaaatgtgaatgggcaattagaagttttcagtcttatgtcaagatacataagtctaaagttttaaatattttcctgagattgctttaatttgtagtatgtcatatctactgcatggaaacaagcatttactttgtcaaacaactaaatcaatgctgagggaaaatgctatctttatacttgaatatagaaattttgaaactgtaactaccaaatgctagttttgtttacataatgtctttaatatctgatgaggaactacactacacatcctaacaaaaataaattctgttacattaagccacaaaattgaattgaattgcactctcttgagaacagtgtccaaggagagattgttaatcagtgaatgcaaaactttagaacaatgaaccaaatgcaattaagcagaagactaacaagaatcataccacacagaaaaccgtgctttgaagaatatgtatcacaagatcgtatcttttggtggtgcactccattattttaaaacaccatcactgaaagaagagaacagtaaacgattttaagaggtagaataattcaaatattaaatgcatgtttgatttttacggccattaactgccctttcacccgttctgctcctagattgcattataagttattactgtaatcgtaatagccctttgagaaataaacttttgaaaaactcaagtggcaaattgatggcttaggttgggaataggttagaaaagatactagtcatgatagcagatggaagggcagcaaggtaggtggctgggagggaatctggaggcggagctgtgccagaaagaacataggaatttaaacagatggaagatgatatatcagttggcagggagagccgctgggtgacaagcagacgaatctattgaagaactgggtggataggcagccaataagtgaattagatgaaccagtaataaaagaaatagatcagtatgagggcatccaagctccagaacaaatcgacaagaacaatagaaaacaactacaattgtccctttgcttgaacctgaggaaacgacttttattgtaatcttttaaagtgcttagaagtgatgatgaataaatgatgataaataagatgatgatcatcttctatagaaggaaaattttagtataaaatttaaagatgcttaccactaaataaatatattctataaaattattatgagcatacaatttattttatgtcctagttttgggtttcctataaattgagttctggccctggcttggttaatgtatgaggctacggggacctggctggaaaataatactgatgcatagtaaaagtggagaataagaactttaattcctttcaaaaaagagaatttaccagactatggcaaatgtgaatatgatattatctttataaaaatagcttatgttgtttttgtctattaaaaatgataatagcagtgtctcaatgaggataaagaagaccattacaagtcatttggtctctcttctgccttcagacttacctacccttaaatcaccatattcttaggcaattattcatacttgcaagcacttagtataattgtgtagtgcagttttgcactttttaaatgacagctgtcattatgggttgatagaaagtaccatacccaggaatatttgtaggaaggacttggcttaataggaccattctgattgaccttcagataattacatggtttcttagcagagaagatacttcaatttgccacattataagcttaaaattcacattctttttattcttccatctaacctataaacttatttttctggtactgtcaactatgtttctcaggccagtctattactttctattttactagccaaagcccatatgccattatgcctgaaactgtgttgttttactgccaatatgatcatttctaaaatatctgtattcccatcaatcccacacacagaatcagggatcatttatctcaagggttgtctgagttatatgaatattcttttcaagtgaattttttttagctgacactttaatctcttgaattaaacttctgagcccaggctagtagcagtgtcttccgaaattctaaatgctatttatacacacacacacacacacacacacacacacacacacacacaagttggagcaatttcctaaagaaccagatgaggcaaattctacacatatgccaggcactaggccagacactgagggatacaaggataaataagatatgaaccttttcatcagagtttatattttggtggatgaacaggtatatatatgtgtgtgtgtgtgtgtgtgtgtatatatgtatgcatatatatatacacatgtatgcatatatatgtatatgtatacaggtgtatatatacgtacatatacaggtatatatatacgtacatatacaggtatatatatacgtacatatacaggtatatacacatatatgataatatataatcgtatatatgtgtatatatagtatatatgtataaataatatatatgtatatattgtatatatgaatacataatcatatatgtatatattataatacatataatatgtatgtatatataacacatatatgtgtatatatatataaaatcagatactatggtacactttaatagatgcaatgatattatattcatgtaatatatgtgtatatcatcctccataattgtaaatctcttgaggttagggaacacactaatttattaattagtaaatatttattaagcctcttttatgtacaatggttatgcaaagggaagatttttccctgttgccatgggcaaaacagtctattgaaaaagggaaaagaaaggagcaaactttctgtgaaatatgatggtacacagtatgtacaataagtgcatataaattgggctctaaccaaaatcaggagaggacatcaaggataacttcctcaatgaagaaatcaaaggatacataggatagtttttaaactatttaagtatttgtataatggttaattcattgttgttataaaataatggtgttgactgtaaacttcagatgttcagactaaaaaagatacatgtatttaatgaacacaatttgaaaggaagccaactatgtgtttggtgttgagataattatttaagtattagctcacttaatcctctccagaacactatgatatcctcacttttaagttggatgttacgctattactaaaactcttcagctcaggattaggagattaaagtttctcttccatatcaccataattttgctaaattttcttggcactttgcagaaattttaaatgtcaatgcatttatatattcagtgatatttcggaacccctatattcattagattgttcatctccctttccttttaactaaaatatatataatggggccagtacaatgttgcatgttaatttttattcagatgctattgattaggagattggagtggggcctcaagatggctgactagaaagaagcctttcatgcccacctcctccattttaaaaaccaaaatagtgtatagacagtcacatattgaatatattacctgagagacggtggtggaattcaataaggaagtgacaaaaacaccaaaagcaggaaggagaagggagagagagacagtctgcctgcccagaatcagctggaagctgggagtgacttcccagcccagggattaggtgagcaagacacatccaatggcccacatcactatcatggaattatgcagtcctgactataggagaaccccttattattctcaacccctgaaactatcatagggagttgccaatagactgcagaaagaaggaactgctccagggagggagcttgcactgggtcccacaccctttctgagacctaagtggctacagcaaggtgccatttttaaacctagcttttgacaggctttctgttgtcctggggtgcagcagcgttgagtctgaggtgttagggaaacttgggctgtccctgatgggactgaggagcaagccgagaatgttcctacagccaaggctaagaagcaagtgaggtgtgggctgtagcggccactgccaggaagcaagcactgctaggacagagactgagacacaagcaggatgcaagttgacactgagacatggatgccagctgggtggacactcctgtagccagggctagggcctgagctaggctcaggctaccactggtagtggtggagtatgagacagacctgtgttttctaccagctatggccactgaggataaccccaccctctccaatggcagggtctcagtatcgctgctactgcttctccccggagcattgcacctggcacctgaggattaccctaccccacccacaatggttggtgcttgctttccccactcggggtactgagcaaaaggccacccagcccggcattgcatctgcaagacagagcacgtagcctgtggccttggggatggcccaacccaatttaccactctggaaccagagcactcctactagcatcctgaagttggctctaaactcccagccactaccacttcagctggcacttatctgcaagtgccatctgtgagcctggaaatgggcccgcctagcccattgctgctaccaccaacatcaacacacaccaactgagacccaaataatttttctgccattgctattgccatcctccatgccacaccagctacccaatgtccaagtatctgaacacccacttggcctactgctgccactactggaatctgagcaagacatctggagtttcaagagtcagccctccagtaactgcaaacaaaagtacctgtgtatatcacccagtggaacaaaaataggcaaactcaacccactgctgccagcactgtggcctgaacactggcccacctgatatcctagtacccagcataacttcaccacagcctccactaataaccataccctaacccaccaaaaaatgacaggcatcactaatgctgtatgtagcaaaagaaattatacagagacacacttagaatcaaagtcaaagtaccctacccgaacaactccatagaaatatccttaggaaaagttctcccctacacaagtaaattcaaaaataggaagaagcaacagttacaccatatgtgcagatatcaatgcaaggatacatgaagcatgaaaaaacaaggaaatgtgacaccgccagaggaacactgtaattctctagtaatagatcttaatcgaaacaaaatgcaacatttcaggcaaagaattcaaaatatttatttttcaaacactcagtgaaacacaagagaagtctgaaaatgatacaaagaaatcagaaaaaacaatccaggatatgaatgagaaatttaccaaagatatttttttccttaagaaaaaacaaatagaaattctggaactgaggtactttttgaaggaaaaacaaaatacatttgaaagtatcaaaactggaagctagatcaggcagaagaaataatctcagaatttgaagataggtcttttgaaataatgcagtcagacaaaaatatagaaaaaaaacttaaaaagaatgagcaaagccattttgacatttgagacaacataaaaccattggatagtcaagttactgatatctccaagggtgaagaaacaacaacaaaaagattagaaactgtttaacgaaatgatagatgaaaatttcccaaatctagcaaaagatttagacattcagataaaagaggcttagcaatccccaggttgataaaatacaaatgtgtctccatggcacattatagtatgactgtctaaagctatagataaaaagccaatcctaaaaacagcaagagaaaatatctagtcatctataaagggaaccccattagattaaaagcagatttgtcagttgaacacttacaggccagaagagaattggatgatctactcagtgctgaaaaaatgtcagtcaaaaatgctatatccagcaaaattatccttcattaatgacgtagaaataaagtctttcctagtcaagcaaatgctgagggaatccataaccactagaccagtcctacaagaaatgctcgtcctaaaccagaaagcaaaagaacaacattcaccagcatgaaaacaagtaaaagtgtaaaatcactggttaaaataataatacaaaggaggaagagataaaactcaaacagtgccactgcagaaatccaccaaacaacaaagagtatcaataagagaaaaagaaaaggacaaggaatatatacaacaaccagaaaacaacaatatgacaggaacaaagcctcacgtatcaataataatcttaaatataaatgaactaaattctccacttaaaagttatagactggctgaatagattagaaaacatgaaccaacttttgctactaataagaaactcaccttaccagtgaagacacatatagactgaaagtaaaggaatggaaaaagatattccacataaaaggaaaccaaaagcaagcaggaatagctacatttatatcaggtaaaatggactttaagtgaaaagcagtttaaaaaaagacaaaagtcattatataatcataaaggaatgaattcagtaagagaatataacaattctatatatacatgtactcaacactggagtacccagatttataaagaaaatattactagatctaaagagagagaggctataaagaataatagtgagagactttaacaccccactctcagcattaggcagattatctagacagaaaatcagcaaagaaacattggatttaaactagtctttagtccaaatggacataatagacatttacacaacattctatccagcgatggcagaatatacattcctatcataagcatgtggaaaattctccaggatagatcatatgtgagacagcaaaacaagtctcatcaattttttttaaaaattgaaattatatcaagtatcttctcagaccacaatggaataaaactagaaatcaataccaagaggaacactgaaaagtaaacaacaagctcctgcattaacattgagccaatgaagaaattaagatgaaaataaaaaggtttcgaaacaaatgaaaataaagacagagcataccaaaacctatagggtacagcaaaagcaatgcaaagagagaattttatagcaataaatgccaacatcaaaaaagcagaaaaattcacaatctaaaggaactagaaaaacaagaacaaaccaaattcaaaattagcagatgaaaaaaaataaaaatgagaccagaactaaatgaaatagagactaaataaacaatacaaaggatcagtaaaacaaaaagttggttattcaaaaatataaacaaaatggataaacctgcagctaaactaatcaagcagaaagacctaaataaacaaactaagaaataaaaaaggatatattacaacagataccacagaaatacagaagatcatcagagaactattatgaccaactatacactgaaaaactggaaatggataaattcctagaaacatacaacctaccaaggttaaatcaggaggtagaaaacctaaacagaccaataacaagtagcaagagtgaatcagtaataaaaagtctctcaacatagaaaaaccctgtatcagatggaatcacagttgaattcaatcatacatacaaagaagaactaataactaccttcctgaaaccattccaacaaattgaagatgagagtattctccctatctcattttatgaggccagcatcaacccgacaccaaaaccagacaagaacacaacaaaacaagaaatccctaatatgtctaaggaacatggacacaaaaatctgcaacaaaacactagcaaaataaatccaataacataacaaaaagataatacaccttgatcaagtggcatttataccaggtatgcaaggattgttcaacatatgcaattctataaaggtgatacattacattaatggaattggggacaaaaaccatatgatattccaatagatgcagaaaaaaaatttgacaaaatttaatatccctttatgacaacaactctcaacaaactaggtatagaaggaatgtacctcaacataataaaggccgtataggacaaacgcatagctaacctcatactcaaaggggaaacgcagaaagccttttccttaagaactagaagaagacaaggatgccagctgtcatcactcctattccacataggattgatacctaaatgtcctgacttgatcactgtgcattataaacatgtaataaaagtattcattgccccataaatttatacaaattttttttaaaaaaagaaataaataaaaagatatttttaattaggagaaagtcaaatataatttgaaaaataagccactcataaaccctaatctaagttaagttaaaaaggtcactttgcttgagtatggaaaatgtgactggcaaatacagaataaagtgccatttgaggaaatacgtacattttacaagatgtttgttgcatgtaccctgctgaaatatcagtgagtatcttgatgaacaagttttcaataaatttatattaattagcttgttattggttcctctaaaatatgtattgttaatagcaggtagaaggaataagttcagtgttcaataataaaataggaaattgtagttaacaataatttacggtatacttcaaaatagctagaagagaagaattgctatgttcccaacacgaaagaaaacataaatgtttgaggtgatgggtatcccaattatcctgatttgatcatcacacattgtatataggcatcaaattatcacatgtacccccataatatatataacttatgtatcaataatcattgtaaaagaaaaaataataatttttagtttccctgaggagatgctttagacacttttgcttccttcctatctctgtcaagcaaaactaaatattaagtagtagagtcttctgtgtaagattgaagattatggagggcaacaatctgctttgttcatctttgtattcctagtgtctagcacagtgccttgaacatagtagatgttcaataaatgtatgttgaataaaagagcacatgaattattaatatgaatacattattatttgtcacaccatccaattaatagacttttagggatttgttatgtttaatgtacatatccaatgtaagatgaattctgtagtagtcgatcttgttttttaatgacgaaaatgtgtctcaaactaacgtaggcaaaagggggattttatgcaatgatataataccacatacctgaaggctgtataagcaaatgctatgaaggatggagtcaaggtgtagctggacctaaagtataccttaactagagacatccagaatcaacactgtcagcttctctgaatacgggcttcatttccaatgaaaactaactcctttatgccttagaaaacatacctgatcctaagtctaggtattttcatatcttgcagcacttccaatccccctcctaccagtaagtatgtttttgtgatagtttttacaaatattatgttgtaaatggccagttcaggtgataaagcataaatattttgttgacatattgattggaaaattaatgggaaaacattaggttgaaaacttgaacagatattctgttcaataaaagttctttgaatattttaataaaaaagaaattgtggcttatgctgaagttaatgaatattagggataaaagtaattaaaatattttaaattattttaagtaatatttgccatcttttcagactccatggaaacaatattctgcttatctctccatatccccaacatttggcacattgcctggtgtattgtaaattgttggtttacatttgttattaatatattgataataaggtcttctcggctcacatatgaatggactacaattaggcagttgtgataagaaagtatgtacaaaactagcaaatgcatcccatattgtgacccactcatacttaaagggcaaattatataatacaaattgtttagagataaatgccctgcaagataagcaaggatctagaccaaaaagaatatgtctggttgggcctggtttgtatcatattcttaaaaatagcctgaaatagtacatcgtttctttggaattcattgaagatgttaaatacgtgggaaatccttgagaggagtagaactaagtagaaataataataaagattttgagagaagtggttatttctgccaaattagctagaagaacaagaacatggctaaatattttcacatagatatatttggatgagacttttgcaggagtgcgtgaatgccaatattgttaattttgtaataaatgccatattttattgaaaaaattctttggcacaatgattttttttttttttttgagacggagtctcactgtgtcgcccaggctggagtgcagtggcacgatctcagctcaccgcaacctccgcctccagggttcaagcgattcttctgcctcaggctcccgagtagctgggtctacaggcatgcgccaccatgcccagctaatttttgtatttttagtagagacggggtttcaccgtattggccaagctggtctcggactcctgaccccacgatacacccgcctcggcctcccaaagtgctgggattacaggcatgagccaccacgcctggccacaatgattttttgaagttattgaatgcaagcaaaatcacaaatattgtttttttgtgtgtgttctttactgaaagtagaatgtagccctcacctatgaaaatatgaatgcctttaagcaaagccttcccttaatttaaattgaacctaaaaaaatgcttcttgcagtagtgaaaaaaatatttttggtaatctaagagtgatattatttagaatttccctctctaatccttcaccaagaataaaatgaaatcttagaaacggaagaagtcttataaagattgtgactaaccctttagtttttacaggtagaaactgaatttctcatgattgattcttgctgtctaaggacctactatttatgcatacccatgcaatgaaaactaagtttaaaagcataaatagttaaaagtgtaataataattgaaaattgcagtaacgtttttcttaattgtataattattgattcaagtttaatgttctttatgtgaattacatttttagtttgagggaaaatattttttaatgaattgtttttgctttgctaagtgatctatttcaagaaacagtctttctccagaaaataaaggaaatttcaatgaaagaaaaagcactcttctgttattccaaacatgtatatttcttagatcttaaccacggaagagtaatgttgaaagaaaatcattcatgagcattgattaggaaattggtgcccattgagatatgctcagcatcaatataaacgtaatttttctttaaaagagctagttgtatgtcagttgacttgctgaaaatgcttcggttatattattaaaaacagaaatttcagtggcttttaacttaggaataaacaagagtaaaggtgagaaacttgaaatgcaagtttatcaatctccctttgtcatatagaaaattgattagaattgttagcccagtaaagtgcagatatataatagatactaaatgtagaaaaactaagaacataatattggctacaaattagacaatgcaagaagaatgaacacaggttaatttaacttgttagtctcaaatatatattatcacctgtttcacagcaaaattatactatttattgtgttttattgacagaacagagtaccaagtaaaagaagaactattagactattaaaaaataaaaaatgccatcacatctgaatttatgttaatgagatggtgttgaataaagctcctagatagcctcaagatggggctagtcaccagaaagaccaaataattagagagctggaaatttcatttccacccgccagcctctggagatgagaggagggctggagagtgagttatataaacttttcaccaatgagattcagggagcatcccacttggtgagcacactggggtatggggagcgtggtgcacccagagagggcacagaagctctgcaccactccccaacccccataacttgccctatgtatctcttctatttgttcccgaattgtagcctttataataaaccagtaaatgtaaagaaagtgtcaaaaacaataaaaaatgaatattagtggaatggaaattaaatattccccattaacagtaaaaaatgattaccgacagattgagttggggaatgtgaattacatagtgactttcgagtgtgatctaaaatgaattcagcaaacagatctatgggaaataatcagtttataggtgataaaaaattacttcagcaataacactgcggaggaagttagaaaaacagtaaactcatacagataattgatacaaaaaggacagagcaaattctccagtaattaataaataaatggcagggattggggtgagggtaaaaaaaaaatggctcacgcctgtaatcccagcactttggaaggctgaggcgggtggatcatgaggtcaggagaccatcctgcctaacacggtgaaaccccgtctctactaaaaatacaaaaaattagcagggcatggtggcgggcgcctgcagtcccagctattcgggaggctgaggcaggagaatggcgtgaatcccgggggcggagcctgcagtgagccgagattgcgccactgcactccagcctggacaacagcgaaactccgtctcagaaaagaataagaactcaaatgcttccatgaagtcctggcagcattttcattgctcccatgtgtcgtcactccacatagcagtagaaaagcttcaccagagtcaagtctccaccacaacaatgctcctgctcattcatctcatcaaactaaggagactttgggagagtttcaatcagaaatgtataggcatcctcattacagtctttttctttctaatttaaatttttgttgttgttgctgctgaggcagagtctctctttgtcacccaggctggagtgcagtggcacattctcagctcaccaaaacctccatctcctgggttcaactgattctcctgcctcaggctcccgagtagctgagagtacagaaacatgctaccatgcccagttatttttttttattatttttatttttttctgagatggagtctcactctgtcgcccaggctggagtgcagtggtgcgatctcggctcactgcatcctccgcctcccaggttcaaatgattctcctgcctccacctcctgagtagctggggttacgggcgtgtgccaccacgcccggctaaattttgtatttttagtagagacggggtttccctatattggccaggctggtctcgaactcctgacttcgtgatccacccacctcggcctcccaaagtgctgggatgacaggcgtgagcgactgtgcctggccctccttatagtcttgatttggctacttctgcttcctttttgttttctaatcttaagcaatctttaaagggcacccatttttcttcaattaataacgtaaaaaagactgcatttacctggttaacttccagggatccttagttttttagggatggactaaatggctggtctcatggcttattaaagtatcttaaacttgatgaataaagtttatattttttatttttatcttttaattatatttttccacaaactttttgaagtccccttgtatttcaattgcaatttctgtagcaaagtacttcaaatcagccaaaactttttttttgttttaacgtttatatttcaggggaaaaaaactgaattcactaatggttgctcttaatttgtgttactttcaaatgttgtgttcactatttatgcaaattaaaactgtaaactgaaattttaattttattagtttcatggaaaagtttagaaagcagtggatttataatgtgaatagcaattacaattatattttactagttatatcccaggcacattcttgaataagaagttgaattacagcctgaaggagtgggctgtccctctcctgttggggatcctccactgggaatcagtggcccccaaccgttttggcaccagggacaggtttcatgcaaaacagtttttccacggatggggtgaggatggttttgggatgaaactgttccacctcagatcataaggcattagattctcataagaagcgcacaatctagatcctttgcatcacttgcacgggcagttcacaatagagtttgcgctcctgtgagaatctaatgctgccactgatctgacaggagctcaggcagcaatgcttgcctgcactctgctcacctcctgctgtgcggcccccttcctaacaggccacagacccataccactcggcagcctggggtttcgggacccctgttctagagtttctaaactctacaaatattttttctaggaatagtcagctttatgccttgacagaatggattctccaggctgtgatttgacatcagaattcatataaggattcatgtataaagaacgcatctgatactcttctctacttccctttaaattactatttcccccaatttcatttatattaagtcaaaattcctatagtgtttaatgttagcaaaaatggtactgtgctctaggctagattattaattcctttcatattgttacctcatttattattgtgttgaaagctttattgactatgtaagctgtcacaatttttttggaagtattagtgtttatataatgaaaaattaagtaggtgaataatgtatgagttagcatctagcccctcacttgttttgaatgagtcaagagattcagatactattttgaaagttataataaacagtaatatgaccacattcagttctcttttaaaacgatatagatgtaataaaatgaaggaaggatatttcgaaaatgctcttttgattttttttcaagtcctttcaaggatgcatgtcacatgtctggttcctagcaaaggtacttggtctttaggtcttctcaaagttgtaagtcctactgaagttgtactgtactgagttatacatgatggttttatattatagttcagacactctagggcaccaggtgtgtttttttttttttttttccagtaacagtagggactggttataaaggagaaaaatcacttctttccctatggattaattgccctcttaaataaaataatcaaatacagtataagaatataatgtaatcatatttgtgatagatccaaattactaaggtaatgaactatcaaaagaaaacattcctgtggagttaaaaggatcaataaatattagtgtggttgtaccatcaaacactggactaagaaccgaagaacctgaatttagtcccttgagattttagacaaatggcttaatctctctaagcttcaggctactgatcattaaaatggggattagtaatacctggcttcaccaattgtcaaactgctcatgaagtacaagtgaaatattccctgaactgcttataatctttacacttatttaaaaaaggtgtaaagaccaagaaggtaaatttaacattagcaacaacaagaaaacctacatacttgattaataagggtgattttatttgattaatatatatgtaaagttagtcattcagggaaagtaaaacataaacaaatgtaataaatacattaatgactgactccaaaagaagcatattatagcttggaaatcatagtgaatctctcaaccaattcctgcaaaactgactcataattatgccccaatcgagtctaccctctgattcccctaatagcaatcatggagcttggttgtaattgattaggagaaacaaaggtaactgtgctagccattatattagggtctctaatttattctcaaactatctgaagaatttctattaaggggactgagtctacataaaatatggaatgctaacaacactttcttaattacctttgtagtaattgctaatgtataataatatattaaacaaataatagtgatttgtattattaaaataaggattttcaatttctcagcatgccatatgcagccaaagccaaacaaattcaaataaggaaaagactctttttttaaagcctgtgagacacagaatactattttagtgagatacatatatggtacatacagtatatatatagtacatacagtatatatgcatctcaccaaatatatatatctcactgtattctgtgaaacatagaatactattttagtgagatctatatatatatatgtgggtactatacatatatgtagttaagaatcaattccaatcaactctttagaaaatgatattgatgtatatttgtaaatgcttgtatctttagcattataatctatgcttgttgagtcaattctatttaatttgaaattgtgatttttacacaggcacccaacaatttgctaatttttcctgaactctccttccatggacatgccctgtaaacctacctatattgctcattatgaaattaacttatgacaaatctttgttcattttacatttttctaaagactgttagcttgcattcatttggcttgaagtttctatagactaggccacagttattttttctttctcttgatttttcagatatgaatttgaattgattcattacttttcagccattatgttagatgcattccaaacagtgccctgcagggctatccagaaggagttttggtaaaaggagtgagtagttattgaaagctctattcctttatatgttataaaacaaaatggatttgctaaagccttccatctgttcctttatcattctttgcattaaaaaaaaaagcttttagaagatgcagacccagtctgaatcttttattgttcccatttcaactgacataaacaaaattattcagcgatgatattaaaatatgagctagtctttataagttgcatgactagatgaataagtataaatagtttttgtattcttcagctgtctatgagattatggttggtgtagatttgtaccaagtgatctgaggggtttctttaattgttagtgggagttgtggataaggatatttactcatttttgcattattactgtactaaatctaagccaattataaatgatcagtccccattttattctttttcattttgaaatttaaaataccattttcttggcataaatggtgtttgtttggcattttgaggtttacaaaaaccatttgattggcacgaaacgatttatttccatccaattgtcttgaatagggaattactttcatctagataactttcagattttagggcatgaaatggaagtattcctgctgggattctgattgggactgtatttactgtgcagtgaaccttcatttgctacaaatcaaggacttttccaaagcctttgagtagacttctgatagtggtagtaattgggactctggattaaaggtggtaacagagtttccatgtgctctgagatcaaataacattttagtaaaattagagcttagaaataggtgtgactctcgtctctagtttgtatatactcttttcacttttctctttccctctcattgtcctggcatttttccagtgcactggggatgaaagccctagtttagaaaaaagtatatacgtgcacactcacatgtgcacacacatgtatttgctttaaatcatatttcacaaaggagtaggtaatccgcatgaaatatgcagtcaaaaaggaagtcttatccatattttgagactctgctgggacatctatctttcagccattctcagcctctctggggttagtcttgctagagaattatatgctcatttttgttaaaacaacaaaactacatttgtaaagttgttattcatacttttttctccccttattgttaccagccaggtccaggtccattctgaccatgcacagtaaattaatcactgtgacgtgggttttgcagaagagaaatttattcacacagacatccagcaaggaggcaggagcacacctctcaaatctgcctccccaaagataaggcttagcgatatttatgagttagggaagtggggtggtctaaggcatggggaaaggtgattcgcagtggggaaaaatgaagtaatgggtttattctgtgcaagtatagtcaggattgatggcatttcataggacatatgtacagaaaatggcagcattagcataatctgagggtcaagttttgggccctctgaggtgaaaaggacatctttccggtgcctgtacaggctccaagttgaaggctaggtggtctcaactggcttgaactggacaggagctggcccaagttcttgaaaaacaaataaatcaaccattaccatggtgaccaatggatgttgtctgtaaagtaaccagtgaaggttaagtttcagcattcagcagagaggccttcagctacagtggctttcagcttcatggaaaaaagaaaaagaataataataataacaaaaagcaagtcagtgaaagcaaacagggctgtcagacccgatcaaattaacccctcggtttccttatagttactcagccatacttaaggttggtatgaaagccatttttcttcttattttatagatgaggaaacgttcagagaagttggcttttgggttgatcagcaatgcttggttttaaacttggctggctctctctgggaccagtgctctttcaggtacctggtatgactgtggcttggctttcaagctctttaccagatttcctacatatcattcatttacccaaaaatgtttattagtattttaagaatcttgtgtgctgccttttttttttagtgccatattctctcaattctaaatggcacatttttcccactactaaaattaatgtcccaatggcattttttttcaaaatctgagaataaattgattcaacagctgatgtcatagaaatgaggaagaacaatatttgcgttccatcactatgcctagaaaacctattacatgtcttgaattccctcttctcctacctctgaaaaaaatgtttgcttttgtgtgaaaactttatgtatctcagttactattatttctattcttacaatcttcctttattaattttcatgattctaaatttattttttaagtcactcagttttttcaagaaataatccttattgcatagttttttttttatcctgagagaatttgatctagtatctactagtttttcaaatgatcttgctaaatagttactgaggtttttcaataatggctggacttattggaatgtattttctccattgcgttaacataaacattatcctgtcttcaaacttacttatattccatgacatcttgtcagtatttttcagccctggtatgaaaaacaatatgtaagaaattaagttttataatttcttgctgactttttctgtctttgccttaactgctggaggttttgttaccagatatgacaggacctgagcagagtgaaatcaaggttgaaaaaaaattgaatgtctgaaccattgaccctaagagcaagagggaaggaagaagtggaaagcattccaaaatattatgttcaaaggactatggagctcaaaacctcagcataaagaattgaagtgaaatcaatggctccattattagtggattaactaaagtattgaacaggagaccaagactggatttttgttgaatgaaccttgcccacatgagaaaagttagtgaaagactcaactgaacgctcaatccaaggcatcctttgtatttgatctgtgacatcaaaactgtttccaacatgtgatggtcatgtttacattgtcttagtctggcttcattaactcattcaccatttatttattcaacacccactatctgtaagacactgtgataaacaagtgatatacaagataaacaagagatatacaagataaacaagagatatacaatccttttttttccccctatagactgtagtctattgggaaacttgggcaataaaataggtaattacaatgaaggctatagctttgatatcaggagttagtctagctccctctctagctctatccgtctcctttcccaagcccctctgcccttactttttgtttaaacagctctgatcatatcaagttattttgaataactttaaaaaatgcaggaagatatacagtccactgaccatatgcctcagtagtgaaaaaatgtgtttatgtatacctgcctcggaatgaagcttcctgtacctccaaatttataataattttccaaatattttctcagcttttttcaacacttcttttacagcatcctagatcaaaatgattgattttagagatttttattaaatattctttaactcattcctactgtatgctaggtactatgctatctctcaaggatataatgataagtaaatagacaggctgacatgctatctatacttaggaagtttacagtctagtggtaaatacacatattaaattaaaaatatgcaaatgacaagtcagcttgtcatacatgttaacagggaaattgcaagagcatagaatttcctcatgggataaaagtgagtgggagagaatttagatgaatgtgaaaagactgactcttggtgaaagtttgatttattttgaatcctgaagaataaagatttattcaagacacaacatgggggaataattagttattcccacattctcatatttagtttcatctcatctcatatttctagatttaaaagtttggtcatggttttttaaagatgtgaattaccttaagtctctaagtcaagactctgtgtctctaaacttggatcagaaactagctggagaaataagaaaagaaaaaaaagactgtcatgcaaatgtctaaccatttaaaatatgaggatttaaggagccaaaggcagatcagcaagtgaaagcttttcacttccgttaacatttctcattctaaattggaagttatgtgctatgacaacataagaagaggatttctaactcagagtaggagagccaaggaacatattctaaagcaactgatttcagaattgagacctaagtgataattaggagctaatcagaagagcagatggcggaaggagaaaaagtggaggaagatagcccagaggagtcagggagtcaagaaagaagaggaatttgagaacgagcccagaggcaagagggctgaaaagtcctgtagttcagtactcggagggtgctggtataggggaacagtggcaatgtgtcactggggaggtgatagggaaggcaatgagagacccttagattgtattaagaagacaagtgacttgattgaatttttgtctgcaagaaagctctggctactgttgtgaaaacatttttgagtgaggcatgactgtgaagcagaaagaatactagagggtagtgcagtaaccttggatagaaatactaatgacctagtctagtggttaccaaactttgttcctcaaacactcccaaaataattttgtaaaattgtatatcatctcatatacttgtgaattgacataaacattcatcataagtttaaaccgttgcaaaatgtaattttcagcatattgtaaattttgccattttaaattgtctgttgtattactcttaatagtatccattagagtctgaataataccgagattcaatgctcgtcattatctatttaaaaatatttgatatatctcttgcacaactctaaaaattttgtgccatttttttctttttaatttctattttcattctcatggatttcactcttttattatatatcatatgctcaaaagtatttaattatctaataatgcattttagttataaaatggttataatttaattttaaacatttcctataaggttttaagtgttaattatttttctagaatgagttgtcaataaaatttttattattgaacacttgaataaatctatataactacatttcaaattctgaaaaaattgttactgacaaaagaagtacaactttattggcaatgtatagcttaatgtaacagacgggcttttaaaattttaatccctctacctttgggagaatgttacttattgccaaaattagacagagtttaatattaattctgttttgaatttgatctattgtcaaaaattatctttaataaacttaattttgttgaatgcaaagaaatggaaattgcttgacttacgaaataatttagttgctagccattcactttctcaatagccataccagtatttctcaacatttatatcagttatctttttgtttggtgctcccaaagagtttacatgctcaatcaatgcacattaaattttgggtgggtgagaagtatgtctttcttctgtaaaataagaggaaggtaactaggaaagagggagctggaaagtagagcctgcacttgtgtctgaagatagagctgaagataaatgtatcttaagttaattatctaaaatctttttccaagtacaacttggaaggatttgtatgccctcaggaatatatatacaccagtttaaagaccactcagatagattgaggcagtgacaatgacagtagaaaaaagtggaaagacattagaaagaaagagaaatataaggtgaaaaactcaataaatttctgtattgtgttagattggtagcatgtataaaagttctagaagtcaacaagagtgggctacattttaaatattcctctggagagtagaaaatcgctgagtagggaaatagaatgatttgcctggtatctggagataatgagtttatagggctgacctgcaaggctgtacaattttctctgcagtcatcagccacaagggtgaagatgcagagaaagcacaaagttgagggctttgcgtgctaatttcagaaagtcgattttgagggatagtgaattattatgaatgaaaattgataaatttcaatttctctgggcaagataaactaaaagtggactcaaacagaggaatgtatgtgtagtagtaaggaagatttgccaaagtatgtcaggcagggaaaagaacttgaggaaaaagtccagcagcaggaggtctgggatgtcctgcaaggttgactttgaggtaatccatacacaaaaataacttgagaatgcatagttccgagaaacaacccctgcagatcaaagcaaagaaagctgccataaaaataatcagaatgacattcaggagacaaagttctggaacattctagactctctctctccaatgttttacaaacatatacttaaagcaactatacaatatataacacactggacattatattatttgaaactattgacatacatattaataagagtttagatgtcaacgtataatatgcaaaggggtacataactttttaagggggttttgtaggcaaaaactttgaagaccactgaaatgaagtactgagaactagaagcagaaatttagagataatgatgtttgtctagatgctggggaatatgtgatgctgaaggttggtgctggtagacttagagtcaattttaataacaaatctacacaacttttccaaagaattgtatgactatgagtattccaaaggtgttcaccaaataagccattctaagaatttggtagggctgttgaaaatagcaaaggcagtatgggcaggtaatacctcttttagtggaaaagaatttgataaattcatcttcattactacattctagcttgcagaggtttgtgggcagtggagatgtcttaggaactttgatgaaagttgacagagaaagcagcctggggttagaaacatttatacctttaaatcattcacaagaaatgaatgacctgaaagcaggtgggttctcagaaaatagacagaactatggtgctgctccagtagagaaatgaagttgcttcccgtggaaaaagtcaagtcagaaccttgatgccttccagcaaaatagtattaaattgatgaattaaatttttctaaatgtgtttttgcatactcatacaaaagaaaatctcggaaaagtcagtcattgtcaccttccaggtacaaaaagctgagctctgcatacacagcccttcatatttccagagatagcccaggccctaaacaggatttggccagcttccttgactctctgtatgaatctgcaagttcctttgtgttttgtttttcttgtctctggtagtggtggtggtgggatattactttttaattctgtgtacacattgccacaaatttagcaactgttaaaacatacttggttatctcaatttctttgggttaggagcatgggcacagcttagctggatcctcggttcagaatctcacaaggttgaagtcaagtttggctgggctgtgttcccttctggagcttggtgttctctttcagttgttagcagaattcagtgccttgtagttacaggactaaggtcctgatttcttgctgtcagctctgagaggtcactccctattctttgcccttctcactgcaccttcatttggcctctcccaacatagcagctcacttcttcaaggccagcaggagacccctttctcttctggaagggcccaagccctcttttaaggactttcacttgattaagaccagcccattcagaataatttctctttcaattaagtgagaaccaacttatctgagaccctaattaagattaacaaacaatatgaaaaaaagctgaacatcacagattattagagaaatgcaaatcaaaaccacaatgagataccatctcacgccagtcagaagggcaattactaaaaaagtcaagaaacaacagatgctggagaggctatggagatgttggtgggaatgtaaattaattcaaccattgtggaagatggtgtggtgattcctcaaagatctagaaccagaaataccatttgacccagcaatcccattattgcatatatacccaaaggattattaatctttctattacagaaatacatgcacacgtatgttcattgcagcactattcacaatagcaaagacagggaatcaacccaaatcctcaacagtgatagactggataaagaaaatgtggtatatatacaccatggaatactatgcagccataagaaggaacaagatcatgtcctttgcggggacatggatagagctgtaagccattgttttcagcaaactaatgcaagaacggaaaaccaaacactgaatgttgttacttagaagtgagggctgaacaatgagaacacacggacatagggaggggaacaacacacactggggcctgtcagagggtggggttgggggagggagagcatcaggaaaaatagctaatgcattctgggcttaatacctaggtgatgggttgataggtgcagcaaaccaccatggcacatgttgacctatgtaacagacctgcacgtcctacacatgtaccccagaacttaaaataaatataaaaaatttaaaacagatataaagaggagatgatggtgaaaggggatgaaaaggttaaagaatatggagaatagacccataagtaggtaaaataaatgactaatagactaatagttccagaaggcgagaacagaattgagagatgaggagaggggtaaactatggactttagttaataaatatcaatattggctcatcaattgtaacaaaagcctcacactaatgtaagatgtaggatataaaagataagataatagcggaaactgtgtgggcagatgaagggggtatatgggaacctatctgatctttttatcacaatttttctgtaaacctaaaactgctcccaaaaagttattaaaataaataagtaaacaaattgtgcaatggaaaaaaaaacaacgacaaaaagattttctttttttgcacttttgccacacagtattttttcacttttgtgtaacctaatacagagagtaatatcccatcatattgacagcttccacccacattcaagggaagaatcaacaggagcattatgctgggggtcagggcaagaattttgagatcttacaattctgtttaccacaggagtgaagggtacagaattatagtgatatttgattatctatatcctgtcactttattataaaattacttgattcaagttttaataaatttttaccaatgctaatgttttcaatttggcttgcttaaataattcaccatccaaaacttttctactttcaacatttaaaactgaagactgctttttatagctgatgtcagtaaaaaatctattaatataattattaatcatacttttccaaaacttttccaactatactgttttccttgaaatagaacacccattatcttacatattacatttgaagtcttcacctgttacaaaccctataagacttttacattttttctaattctttacataatattgatcagaaatcggatttttaaactcattaggctcaattcaacagacaaaattcatctttataaacatatattgcatactttattagctagtcagtttgccaggatataaaactgaaaaagattattctgttctcaaatagtttgtgaaaaatttcctgatgatacattaggataatttttaatattttgtctggatgtcttctaaggtctggtgcaatatgtgtgatgtcttctttaataacacttatccagttttgattctctggacaccaactgggtgttcaacaattcaattcaattgtgcctttaatttattggagttagtgcagaccccacaggttaatggctcagtcttacaagattgccccccacttcagatgccagttgcaagcctcaagcttcctgtatttctgatcaacgggctacaaattgcaggctcccacgacatcttacacaggtttaataaattgctgtaatgtctcatagaactcaaaagaatgctacttactattaccagtttattatgatggatgcaactcaaaaacagccaaagggaggagatatgtagggcaagtatgggacaaggggcaggagcttccatactctctctaggcatgccactctcccagtaactccatgtgttcgccaacatggaagctctgcaaaccccagcatttagggattttaatggaaagttattacttacacatgattcattggccattggcagaaagtttgaggtggggctgagagttccaaacttctaatcaaggcttggtatttctggcaaccagctccctcatcctgaagctatctaggggcccacaaagagtcaccttattactacaaaagatacttccatcatctttaacactcaggaaattccaaaagctttaggagctccgtgccaggaacaggggacaaagaccaaatatctatgttaccactcagggtaatgtaactaccaattcagaaattatcactgtacaacataatttaaattactttggaaagaaacacatggctactttaaagttaattgaagcctatttgctaacttaaagaacatatcacattttcttgacatttgccccaactgagttggcttgtccatgttaagtttttttctctttctgcagacttaagtgttttggctgcatttgtctcagcccatttataaaacattagatgaaatgttttatctaatgctcctagcactaatccttagggaactctgattaaaagttttctatttagaaaaaaatacatactcatgtttaaatttgcctgtttaaaaaaaaagtagaaatgtctctcaagtacctagtgaaacatttttaaagttttttaatggaatcttgtttcataaattaagaaaataagtgtaagtaatttctactagttttctttctctttgatttttttttctcttagccagagattatttaggaatgtatcttccccttgaaatactgctggattgctccccagtgcaccattttattgtagaagtgagattcactcactctataataatccttaagaaccgttctgtgcctatttatatttaccaatttctttaaaagaaccctcttcaaaaaagttattttcagtttactcattaattttttattggtttcctttgagtttacaatatgtatctttacttaatcacttttgaataatattatgccactttctatatagtacaaccacctttacaacagtgtacttccagttctttctgccgtcactgttactgttgtcatacatggcatttttacttatgtcttaaacctcacaacatattgttactatttttgttctagatagtgaattttcttttacagcaattacaaattaggaaaaagtgggagggttgcttgaggccaggagtttgagggctaggagtttgagaccagcctgggcagccgagtgaggcccctgtctttacaaaaataaagaaaaaaaaaaatagctgggctgcacctagcttctcagaagtctgacgtggaacaatcacttgtgcccaggagtttgaggttgcagtgacctatgattgtaccactgcattccagtctgggtgacagagtgagaccttgtctcttaatacacacacacacacacacacacacacacgaaatatttttcttatttaccctatttttacttttctgatcctcttcacttctttctgtagatccaggttgtgttcagtgtcatactctttctgctgtgcagcccagtttctaacaggtcacggactggtaccagtctactgcctttcacatttcttaaaatgtgggtttccctttatggggtttacagaggttactgatttctcctgtagtctgacaaaaataaaatgttacatgtgtttcctctccttttggagaggtttggctttttttgttacccaggttactcggtggctttacaacttcaggtctctgatacactcaaggaaagttatgaatatcatctggcttttttcacattgttacacagaggcgagattctttgaagctttcagcatccaatgcagaagcagaagtccactcacaattcactccttcagtgattgtatgctgtattgtcaatgtaaaggtcatgaaaaaaatctccttgttatttcatgaatttaacactcttttctgaactgggtaaagactccttctttcactgaatttgccttaataccaagctacatctgtaatctttataaatactgaatacatgcttattgaaagttacagagcaaactggtttttctccccatttcatcctaactgtatacataatattttgaaatctaccattactataaactagaagcatttttatatttattaaatatttacatcttttctctaccttattaaatgaagatgtattaaagaaagcatgttttaactttagtcatttaaaatatagctatcacatatttgctgttttataggcattgaggaagatgttcatgagagcactgtcctaatgacaaaaattgggttcagggaccttgatattttatgaatttaaaatgataatcttagaattattgccaaatagaactgcaggaagtatattatgttcaatgctggactgttagaggttctgaattaatgtttatgaatataagattcatccatgatacttaagaaagctaaaattgttgggattttccttctatatactgttatttcagttaaaatataattgatgaatagataatttataattctaattctaaaatactgtaattctgtattagacagaataggctaagataaaataggcaacaattgtattaacaaatatccataaaaccttaagtatttgacatagtaaaggtttattggctattcacatcacagctaaatgcactaatatcctatctcttaatttatgtatagcaaataacctctaaggattccctgtagtaggagtccccagcccctgggcagtagactggtaccagtccgtgacctgttagaaactgggttgcacagcaggaggtgagcagcagatgtgcaaatattaccacctgagctccaccccctgtcaatagtagcattagattctcataggagctggaaccctattataaactgtgtatgtgagggatctagactgtgagtttcttatgagaatctaatgcctgatgatctgtggaacagtttcatcctgaaatcattccttctcatctgtggaaaaattgtcttccacaaaactgggacctggtgccaaagagattggggattgctgctgtatagaacaacaaagggctggaggattaggtgggatctggaccgaccttccttccttccttcctccctccctccctccctccctccctctcttctccttctcctccttctccttctccttctgcttcccttcccttcccttctctctgctttccttttttttttttttttttttgacagagttttgctcttgttgcccaggctggagtgcaatggtgcgatcttggctcactgcaacctctgcctcccaggttcaagtgattctccttcagcctctgagtacctggggttacaggagcccgccaccacgcccagctaattttttgtatttttagtagagacagggggtttcaccatgttggttaggctggtctcgaactcctgacctcaggtgatctacctgccttggcctctcaaagtgctgggattacaggcgtgaaccaccatgcccagacctatttttctttttcttttaataactttattgagatattattcacataccctacaattcacccatttaaagtgtacaattcactgatttatagttgtgcaatcattaatctaatttcagaacatttttattccttaaaagaaactctataagtgttggcttcattctgcccccatcccctcctcttacccctgagcaatcactaatctactttctatctttatgatttacctattctggacacttcatgtgaatgaaattgcactatatgatttcataccttttgtgaattttctttcacttagcataatgttttcaaggttcattgatattgtatcatgtaaaactacttcattcctttttattactgtataatattccattgtataaatataccaccttttctgtatccgttcattagctgatggacatttgagttgtttatgctttttggctattatgaataatgcagcaatgactatctgtaagttttgtgtagatatatgtttttatttctctcatgcatacaattaagggtggaattgctggggcatatggtaactctattcttaaatttggaggcaaagttaccaccaaactgttttccaaagtaacagcactatttttacatttccaccagcatgaataaaggttcctttttctccacattctcaccaaaatttcttcttgccttttttattaaagccatcatagtgggtgtgaagtaatagtttattgtgggtttgatttgcattttcataatgagtaatgatagcaatgatttggatgtcttttcatgcgatcattgtccatctgtgtatcttctttggagaaacacctcttcaaatcctttgtttatttatctaattgggatttttgtctttttaagtattgagttataagagttcttttataattctggatacaagtcacttattagatatatgtcttgcaaatattttgtgctattctgtgagtagtctcttcactttcttgatgatatactttgatgcccaaaagttttcaaccttaatgaagtctaattctatttttgcttttgttgctgatgctttttgtatcctatgtaagaaattttggcctaactcgtggtcaaagatttactcctatgctttcttccaagaaacatacaattttagctcttacatttagatttatgacttattctgaatcatttttttggtatggtgtgaagtaggggtccaaacttattttttttgtatttgaatatttagttgtttcagtaccatatactcattgaactgtcttcacattcttttcaaaatctattgaccataagggtaaaggcttatttccatactctgaattctgtcctattgatctatatgtctattattaccaagactacattgtcttgattattgttactttgtagtgaatttgaaatttagaactgtgaattctccactttgtgcttcttctcagtactcttttggatattctgggtcccttggattttcatattaattttaagattggcttgtcaaaatttgcaaaaaagtcaggtgaaattttgaaagggattacattcaatctgtagaatactcttgggaatattgacatgtaaaatatattaagtcttctgaacaacgaacataagatgattttccattaatttaggccttttgtttcttaaacaatgttttgtagttttcagtgtaaatttcttgcacttctttcatcaaattctttcctaagtatgttattcgtcttggtgctattgtaaatttaattatttttaaattgtatttttagattgttcattgcaagtatatagaatatgattattttttgcatatttatcatctaccctgaaaccttgctgaattcatttattagccataatttttttagtggattccttagaattttctaaatacaagattatgtcatctgccaataaaaatagttttattcttttttcccaacctgggtttattttatttctatttcttatctatttgctctgtccagaactttcagtaaaatgttcagtagaagtggtgaaagagacatctttgtcttattcctgatcatatgggaaaagtattcagcaattcatctttaacataatgttagcagtggattttgtgttgatgctctttatcaagttgggaaagtttccttctattcctagtttagtaagcatttttattataaaaagtgttggagtttgtcaaatgctttttctacatctatgcagggtgatcatatggtttttgttctttattctattaatatgatgtattgcatcaattgatttttggattttaaactaacattgtgttattgggaaaaatctcacttggctatgatgtataatcctttttacctatctagccagattcagtttgctaatattttgttgataatttttacatttgtggatctcactcacctgtttatttttttatatattttacattgataactagatgtcttagataataacatcatagcaactctggatactgatttctccaccttgctattgttattgttgtttagtttttggtcatttgtgtatttgttttgtgatccagctgaaataactttgtgaagtctttctgtgcaggatgtttttaagggccaggcctaaaagttacatacatcacttttgccccaatcccaaatgccagaatttggacatgtggtccacacctaactgcaagagaagctgggagatgtagacaagcacagtgttatttggtgagcaccagaagtctctaccatcattcaaacttctagttatcaaatatctcttttccacatttaatgtaccttgttgtccaaggagttcaatcgtaaatcactgaattccaagttgaagaaccctcaagtcaggaaatgcatccacttggtctagtgacatagaaactaaaaagacaaggtctccccacaccccatctgcatccatacatgcccctaacctaaatggtggggcaggggaaagaaaaatatatctaccattaataaaatggaaggctggatgacacacaatgatcactaatctttctatgagatattggtcaaaggacacaacatgtcagctaagtaagaggaataatttcaacagcatgggactatagttaataacaatgtattgtatttgaaaatctctaagagtccatgttaagtgttttcactacaaaaaacaataagtatgtgaggtaacgcatatattaattagctcagttgaaccattccacagtgtatacatatttcaaaatgtgttgtatatggcaagtatatataaattttatttgtcaatttaaaaataacttgtctgcagaaatactagaatcctttaggacagataatttttgaagtttttctgctctgacagtgagggaagtctcctgagactcattcatgctctgctctccaagcatgaatttttctctttacttttctctttactttgaatgaattttttctctttactttgttaaacgtttactaatataaaatggagtcacactggttcctttctgtaaagggagagaagatgggctttctgagtttattattattattattattattattattttgttgatatctttggtggtacttttatatttgtgctactgtggttagaaacaccactggattacatcttagctttgaacctaattttgggacctgttgtaatttctggttttagctttactactggagaaattatttgctttgagaagttaaaagtgttattgagtcccaacttactaagatcttttagattttattatttcttgagataatagcttctatttcttttctttatttttatttctaatgtatttcctttctctctgggcataagatcttcaccaccataaataaaaataattatcccaatggaagttttttatttattagaactaggaggccgtttgaatgctaagttttctctatacaaagatcattaagattttaatttggatgaaaatttgtaatttgtaagtaaaatttcaaagcaaagcttctaatccagtctgttaaacgggattacagaggattacatccttggtagatgggagcagagattcaggttgagtcagtacttatgtggttcaacctgaatctgaacccagaatgccagaggaacagtcgctataataatttctataaagtctacaaaagggtaattaaggatgctgaaaactgacctcagcagtagcattcctttactcttcacttccacggacctaactcccctgctctctgcgttagcctcccggaactactttcacctccttaaaaattgccctctttgctcctcttgatgcttctgcacctgctccctctgggtgataggttgccattgatcctgtggctgattgtactgcatcccagcctgaacacctatccctgacaatttcatggtctttgtctctacgtgcagtcaattataaattctgtgtggattgagaccaactgtgttttctcttcccagcagctgtaacctcacatgtcccccgccactggtactgtgctagaaagcaataatagatgctttaaaaagagttgtcatatgaataaaatctcacccacttctcagttttgcttgagttacggaccttgaagttagttatttgctatttagaaattttgatactacactgtcattattcatttcagatttttttcagaaatattaaagtcaatatttctgtgaaaattgaaaaaaaattttatgattaaatttctattaattttgaataaaatgctacattaaggaatgaatgttttgatagtttataaaacacaaaataatactataataatttaagtgatatacaataataatttaagtaatattctttaaggtttgatctaaggacacaaatatatgcattaaatattgaaaaaaaataaggatgacaggatactagatccatcatttcattcctctttttttgttttttgagacagggtctttgtcacccaggctggagtgcagtggagctatcacagcccactacagccttgccctccctgggatcaagtgatcctcccaactcagtcgccagagtaagtttggactacaggtgtatgccaccatgcctggctaacttttgtattttttgtagagacaagtgtctcactatgttgcccaggctgatcttgaactcctgtgctcaagcagtctgcccacttcagcctcccaaagtgctgggattacacctgtgagccaccgtgtccagtcttcattccttttttatatacatatattattatagtcaattcatcagaatgaactatagttcataggaaaatattttgtatatagtttcttgataaacaatgcttgttattatgctaaacctattgcaaaatctatagtggtttttcatatcatgttgctttcatggtttgcaaaccaaacacaaatgaactattagaaccactaattattttgtctgttagtgaagatattggaatggaaattattttgagtttcaaaggtaaatgatatactctgaagacaattattatttttctcatttaaaatgtacattgatatggtttggctttgtccacaccaaaatctcatcttgaattgtaactcccataattcccacgtgttgtgggaggaacctggtgggaagtgattgaatcatgggggtgggtctttctcatgctgttctcatgatagtgagtgggtctcacaagatctgatggtttcaaaagtgggagtttccctgcacaagccctcttgtctgctgccatgtgagatgtgccttcaccttccaccatgattgtgaggcctctcagccacgtggaactctaagtccaataaatctcttttttttttttctaaattgcctagtcttgggtatgtctttatcagcagcataaaaattgaccaatacatacaggttccattagaattattcaaagaataaagcaaaaatattaacataaaatgactgagttactggaaaatgggactactcatggcagaatctgttgtaacaaaagacttctttgtcaaaattgtcatttcatttgggatctctttttcaattctcaaggcaaaaataagataatttatatgtatagtttaatttgcagtctagggagacttggtatataactctagccataatgtttatttcaacttccatttttttgacataaggcactcaatcagacagataatagattttcatttccaaacctaacatttctggcagtcctgggcagcactttctggagggaaatcaataaatcaaattttaatcagtatttattgagcacctgctaacatagatgctatggtagggaaaggttatgggtgaaggaatgacagaggtttatgagatattgttgctgatctaaagaaatttttatgcagaatagatgcacataagacacatgcacgcacacacacacataccaacccaaacacaccgtcacacacaaataaataaaaagcttattatcgttgagcttggccagttcataaatggttggtctgagtggaaagactaatgagaactacagcatccttggtttgcagatgtttccatcttgtgttatatagagttagcaaacaagtatctaagaataaaagtgagtgaatagatgcagttcctccttgaagcatacctgaattttgtgctctgtctacctggaggagagagatgagtgaggattctgccaggacagataaacataaaccactgtctcacaaccttttattccctggaataatcctaactaatatttctcttgctaccataaaagacaattctttgttgggagtcagttatgtaactagtgagaaatccctaagtagtgacttggatctgttacagagaaaaaaaaaaaaaaaaaaaaaaaaaaaacagaagaagcagctagaggatgataaacacagggtatggtattctgtgctatgttcaggaagcaggctggagctgagatagattgaatactatgggacttacataatacctaattgcaataagttttcattgtatgactctagggagaggagaagtatggcttaccctttaaaagatcattctaagcaattttatagagagtagactacagggaggtcagttgggaggcctggactacagtagtagtggaaatatggggcaaagtggttggatttgggatattctgaagctagactctaaacatcttgctaatagattggatatcaatggagagaagaaggacaatcagtaatctctgttttgtgcttgatcaactgagcgaatgttagtttcattctctgaaatgatccccaaagagacagaggaagaggtaaaatgttttgtataaaatgttaaggttatattttgcattttacatttccaaaatagaattaatttggctaaaaatgatcatgttcaatggagtgagtcagaccaacttgcataattctaagataatttgaatactcatctgttatttttcttttggctggaggttattgttggtggtggtagtttgacagaaaaaatgcagattttttggccaactatgagaaggaaaaacttgacacagaaaaaatctggtttattgagtgatttctagaaatggaaggtatttctattttcctaaaatgtgaatttatatttgttttttgtccaccactgaatgagattggatagtctttgagaggaaatgataaaaaactatttttacttttatggggcccctttcttgaagttacctcggaagtcatctactgtgaatcttgattttatagtaggagaaaattgagctattataaataccaaatgaattttaaaaagatcttacatatttaatcagtcagcacagaccttgagcttaagagatttcggtagggtttttccgttgctttgtttgtgtgtgtgtgtgtgtgtgtgtgtgtgtgtgtgtgtgtgtgtgtgtgttttccctatcatgatacagaaaatcacaatcattatttacaaaattaaaaacttttagtgtatagttatgtcaagtgtaacaaatcaatatcaagtatcaaaatcattaaatgaatttgtgtggactcaaataaaggcttccacaatataaatgaaatgctctgcttaccctgccttgagtatttctaactatatagttatcttgagagggcttagcgaaatgcctctgatattcaaatggcctttgaaatactgattatactgtttacaataatagtttgtattgcatgtactaagcattttttctttctttttttttttttttttttgagatggagtctggctgtcacccaggctggagtgtagtggcgctatcttggctcactgcaacctcagcctcttgggttcaagcaattctcctgcctcagcctcctgagtagctgagattacaggtgcacaccaccacgcccagataatttgtgtagagatggggtttcaccatattggtcaggctggtctcgaactcctgaccttgtgatccacccacctcggcctcccaaaatgccgggattacagtcgtgaaccaccgtgtccagctgtactaagcatttttatagtcattttcttgttgcatatttacagcaaccttatgaatctggtactattattaccccattttaaaaaatgcataaacttaggttgagaggaaagataattgcctcaaaccataagaaggtaagcagcccatccaggacttaaaccccagtcaggctgacaccaaccccatgctgctgtctactctcctctgcaattttagtagttagtaacccaataaaagtatcacaatcatgtgactaaattcttacagaaagtggaacatattataatgaagacagagaggcattaggtaagaaacagaaaatgcctaagtaaaaattctaaaaagtgctataagatatacaaattattttaacctttttacacacaaattgcaagaattatcattagtatatattcctgaaaattttagcaatttgatttcctgtcatattatacattatatgtaatgaaatatggtgtattataaaatgtataagacataagcttaactcatgcctcaaaggatagttataatcctccttattgaacacaactttgacagagctttcttgggttaagcttttgattataacacatgtattttaaaacataatatagattctccatattggtttgattgctaaaatattttttaaaccaaaacatgtaaaatttgagcaatttttctttgcttcttccaaatgttcctgttaaagttttagtgtgttaggccaaaggatatttataatgatatgaaaagccttaacatatgtttttgcagtccatgatatttgcccaaggatcttccttttagaatacaatacaattttaagatgtaccaatatgttttaaaggccatatctgtaaaaacccaaaacataattcaattctaaatttctccactctttcatcctctacatttttttttgtcagtttattactctgtagactaaaaatctgtaatggttcctcattgcccccaaactaaatatgtaacaatagctatcaactattggaatatctgctgtgtactgggccctttagtacattacctctcatccttccaatcacctgctacatatagagacaggaaaactggagcacagggagctgaccttgaaacccatgtctatttgatttgaaaatcttgtattctttccactagaaatgatggtacctcctatttagtaaatgcctaccatgttctaggcactatactcaggagtttgggttcaaatcccagctctaccattcccaacccatgtattcttgggatcattacttaaactttctttgcctcagttttcctatctataaaattaggtaaataataataataagagtaccttatagggttattgggaggataaaatgaataatctatataaagaatttagtatacaacctagtaaatacaaatacgtattagttatcattatttttattaggaaatacttcagatatacaaaaacctataatgataataaatatcaaagtcacaacgaaatttaaaggatagaacattataaacacaattggagcacatgttattttgtagctcagtatttatccttcttgtgcatgcttttgttctttcattatagatgtgtatattattttacagatgtctaaattataaagcaatatatagaaacattttcaaattttttaatggatgagaccaactgcattttttctgtaacctgctttttatgataaatatgacgcttgcaaaatccatcataattgacaaatgaggctctagttcatttattttcactgctatgcactatttatgaatgaaactgcagtgaaactagaataagtctattgtaggaatgaaactacagttcattcatccacgctattattgatgtatatttaggtgtgttttaaaacttatactatttcataaactgctatagcataataaatgatgataaaaataatataaaacactttctaatgcttacttctcaggcaatgatttacatatgttgaatcatttaatctcataaaatctcataggaagaactattattatctacaatgtacagatgaagaaagtgggtcaacttgacacatctggtacatggtgttcctggaaataaaaataaggtaatcaggccaagatgtagctgtcttgaccacatgtgcctttgggcacacgtatatacaagagtgctctaggactagttctccatcttgtctgcacattaggatcatctggacacttaaatataatgactcatgcctaaacctctttccagataaattgactcaaaatagctggggatcaagtctagacataaatattgtttaatctgatttttaattaaacttcttgttctgagataattgtaaatttgcatgttgttgtaatactatttaccatttacccagtttgccccagggataccatcttgcaaaaccatagtaaaacatcacatccaggattgacattaatacagtcaagatcctgaacatttctgtcaccacaatgatccctcctgttgcccatttgtatccacacccatttccctcctgctcatcccctccttaacccctcacaatcagtaattggttccatatttctgtaattttgtcatttcaggaatgttataacattctatataaatggaaagtcaattccaaaaggttgcatactatataatggaattccattatataggattatattataggattctattacacagtgtgggatcccattatataggatttcattatatatacccttttgggattgaccttttttaatctatcaaaattctctgcagattcatctaggttgttgcatgtataaatatttcacttcttttatagcttatagtagatcatggtatgtaagtaccacagttggtttaaacattcacctgttgaaggatatctggattgttttcaggtttttttggctattaaatataagcttctatgaatatttatttacaagtttttgtttgaatgtatgtttgcatttctctggaataaacaccaaggaatgcaattactaggccatatcacatcctgacttattcttgtcttttaagtaaattgtgttaactggccaacacctctctctttgatcacacttaaaggtcaaaaagtcagtgtctatctcaaggtaacattattttttatctccaataatgattttaccaccaatatttttaattttgatatgaatattatttctaagaaattggagatcacaaaatagctacaggttaaatattgctgacatcatttagtaaaagccaaaaaaaaaaaacccagaaaacagtttaaggttttctaatctacagagcaccctacaaggaaattaatatctgtatgcaaccatctcactagctttgtttaccagacacggcatgtgagaaagaaaacacttcaagtgtttaaacatttctaaaatcaaattcaaaaaagcatacttttctaatgagatgttcattgacttgaaaccaaagtaacaagaatgctttgaagaaaatatacccaacaatttgtatagtaaagtgaatatagtgttccatttaaacctcatagaaccccatgaaaaaattaaccaagtaagattggatgatatccacatcctagaggcatgtttcttatttattggaaatttgactaaaccatcaatatgaccacctttattctcagatatttttaggatactagagccaatgaatataatgttctattaaggagaatatgtttaaataatcacagaaattaaatatcttattccattattatttaaaaagttgtatgtgtctatttttataccaaaacatttcctattaaacatatatgtatatataataacttttcttattagctttgttttttcctaccttctgcaaccagaaatttctctgcttccttgagacagaaacataattgtgtatctgttggacaaatactattttccttttttaacaaaactttttgatagaagagctttatgttggcatcattttaatgaattcaatacattcattaaagaagtggtaagcctaataatatatttgcttctgtgcattatttttctctaaattttgggctacttgtctttgtatactgtttcaaaacctaggcactcaagtgtgtcattttccattgcaattaatcacttggttttgagctgctctaagaactgaatttcgccaaaataattgtgagtatgaactttcctgtttgtgagcttcttgaacaagttggcatattttcccttcgacaactgtcaccatctgacaatttgctattatagctagactaacattaagatttaagtatctaactctgggctcagtgaaggtcaggcatatttagacagttttccacagaaaagtttgaagttaataccctgagtttccttgaattgcatttaataacttccaggttaaaaccccaaatggtagaatcaaataaacagactcatggcataggtcctgagagatgagcaactggagaaagaggttcagatgagattatttcctctgaaagtactagttcctattgtcatggaggaaagaagatctagatgaatattcatataacccagttttctgcattgcacattacagaaagtctacagagaactctctgggagagtgagtcagaaaccaaaatcaatctgggacaatatatcatttattttcatactggaatgactttcaaatcgtctacttttattgttgttaatgacacaagtttctcctatgtaacagtctctgaatcaaactaagaaaaggcataaatatactgatgaggtttatataacccatgtctaaataatcagaacaaatcactaatggcatttaaaatattccaaaatgcttgttacttcaacttgttctctctataccatttcatatgcctgtttttctgatacttacttcttttgttgccttatccaatcacaatcaggattaaagcttgggaaattgagaagtgacccaaatttattataggcaattatttttccacttctgcctatctgtccctgtaaactttcccctcatcatctgatgcctaatatattgaagtccccatcctgctatcttcacctcttccttccccaccaaagaaacagttttttccttttttttttttttttttttttttttgagatagagttttgctcttgttgcccaggctggagtgcaatggcacgatcttggctcatagcaacctctacttcctgggttgaagcgattctcctgcctcagcctcccgagtagctgggattacaggcatgcaccaccaagcccggctaatgttgtatttttagtagagacaaagtttctccatgtttgtcaggctggtctcgaactcctgacctcaggtgatcgccggcctcagcctcccaaagtggtgggattacaggcgtgagccactgcacccagccaagaaacaattaaaaaaaaaaaaagaaccctgttctctgatcattcacagtaagttataaatagctcataaaattactaaacatatacaaaaacaaatcacattttacaaagagggcaaaatggtctagacttaacatatagaaagcaagtcaattttttctccaactacaaatgactgacatgttcaattagttttaccatttttaaaaaaatcggagtccattatccagaactcacatgaggaaaagtttagacaaaaatggtaaacccaaatcacctacgcaagatctttatgaatgggtgtgatagtccattatgtgtaatgttactgaactagtagctgcaaaacttttgtctattttccattttctgatccctcttaggaagtaataacacatttttgtaattcaatagctatcgccatgattcccgaaataggggcctactagagtattttacattttttgagtgacacccaacttctttatctttcagatctcaatattttgttttatgaaagaatcaaagtaagaaacctaagatatgaaaaaacacttatttccaaaggaagagatcatcctagttgttcgaaggcttacatgcttaatgcactttctatttgttaatgagacttgttcacattatatagctttcaattagttgttttgaattaatttttcatagtccatataaaattataatattacaaaaataaaatcaacacgactgaggagtctgaagggcagcgaggtcacatatcccagccttggtttattcagagattgattaacaggctgtgccttggagttggctcatgtgcaagaactaaatcaatgtcatggtttttcatgttgaaattttaaggcaccatgatgactttaattatatatattaaatttatcaaatattataaacagcacactttactgtttctttatagaacattggttggcagctcttttcgaaaaccagtcacccatcagaattttatttactacttctccaaaggattttccaatattcttcctacagttaagtaaaggccatttctctggcatgtgttttctaaagtcccttagcttactcaaatattctaagaaaacaacaaagatcctgcttctctaagcaataccagacataaaattccccaaagagaaataaattgagcattttatgctgaaccaagaatgttctccttctctctccttttttatatgttatgcaaaatgagccaaatgatggggattaggaatgagaaaaagaaaattaagaaaggagtgagacaaaaatcaagggtctagtattatatcacctaaaaataagatatgtgtcaggcagcaaggagggagattacagaaactaactgaaggctgaaataaaaatatgcatagatttgttcttgatttcctatgtataggaggaaattatggtcctctgtgagaagacaggttatgaagttcacagagacacgtaaattctttgttacaatcaatcctacttgtgttatgacttttgccttttgtgaaactttatgtccttgttttttttctctgttgggcatttagaaatttgtatcaagataaagaaaaaataggtaactcattaaaagcaagaaattcgtagtgattattgcatgctacatgaaaataaacagcattgtcttatcaaacaagctgaataaagattgtgaaaaatgtctgtagtaatacctttgctccaagaattttagtgctaactgctgcaaggaatacaaaatggtgtaatacagagtgtactctcaaggaacaaatttatttgaggtgacgcaaagtcataaataatgtaaatattatataataaaaagtaaaaagcagattagcaataaggaaaaggcagattatatagtggatacatactatgagtgtattcatttattcaacaactatttcctgattgtcagtaaacctaaaatcagctagattttagagatccaaagattattgtgaattggacaatttaggaaatctgagtaagaggatttccttttagtaagtttttatgtacgtttgaaggggatgtaggagaatattctttcctaagtggatgtaaatacgtttgctgagtaaatggttataaagaaaataataaagtcatcaagttttcaggatataatgataaatacctttgtctgtaatgccaagtacaaatacatttctgcttaaatgatatagaagtgagaatgctagaaaggagagattttaatcattattcaaaatatttgctattggtgctatgtgcaaaaagaaactttactcttaagcaagtagatgatgtagtaaaagattgtgcgtcacttagtactcctttgacaataagtgtcagagaacccagctaaagctgaccaagaaaagaacaggtttgtattgatacatacgactgaaaagttcagaagtaaatatggctgtacgaatactctggaacacagatgatttaatcaggaacttgtttttatccttctcttgactctattttcttctcaggctccatgacactttttttttcagttttaggcttatatcctcaaagcattcagtccggtagaaaagagagggaaactttggtttgcttctgagtaaagttactgtgttctatgcttggaacttctaaggtcagaagcttatctcttagccaatcactggggctaaaacgatggaattacacagatttacccgtagtagactacaaacctatctttcacctcctgtgaatagaagaattcagtaatttagtgttataactggataagcatagaatctatgtgctcccacatacatccacatagaatgagaatggaggaagtttatttcccagagaataattgttgtactggaaacaagtgcaatgcagaagttttgtaaacccacccaaatatttactccagggtgttgtataatagcactatgctgaaagggttggatgaaagaacacttggagagagaatgaacacgtactatggctataaattgtgtgaatttgagctatatacataaactggaatggaaagggtgatattcatgtgcaaaattttttgaagaatgacctggtagagcttggtgattgtctattagtttatccaatagtagatgttttcatagttacacatattagggctatactatggccagaggttcctaaacttttgcaagttacagcactcttaatttttcggttatttttgcatggcaccccttcaccaaaataaatgattaagaaatacatttaataaatattgactactccagtaggcccctattttgggtatcacagctatagctattgacttacaaaaatgtgttattacttcctaagaaggatcagaaaatggaaaatagataagggctttgcagctattagttcagtaacattacatataaaagactaccacacccattcatgcagatctcgagtaggtgatttgggtttaccgttttgtctaaatttttcctcatgtgagttctggataatggactctgatttaaaaaatgataaaactgatttcacatatcagtcatgtgtagttggagaagaaattgacttgctttctatatgttaattctagaccattttgccctctttgtaaaatgtgatttgtttttgtatatgtttagtgatttaatatgctatttataatttactgtgagtgatcagagaacagcgtttttaaaaaattggtttctttggtggggaaggaagagatgaagataggaggatgggggctttaataggcatcagatgttgaggggaaggagtacagggactgataggcagaagtagaaaaagaattttctgtaataaatttgggtcacttctcagtttcccaagcattaatcttgattatgattggataaggcaacaaaagaagtatcaggaaaataggtaggcatatggaatgatatagagagaacaagttgaactaacaagcattttggaatactttaaatgccattagtgatttgttctgattatttagacatgggttaaatatacctcatcagtatatttatgccttttcttagtttgattcagagactgttacatagaagaaacatgtgtcattaacaaaaataaaagtagatgatttgaaagtcattccagtatgaaaataaatgatatattgtcccagattgattttggtttctgactcactctcccagagagttctctgtaaactttctgtaacatgaaacacagaaaactgagttatatgaatatttatctagataatctttcctctaagacaataggaactagtactttcagaggaaataatctcatctggacctctttctcctgttgcccatctctcaggatctatgccatgcctaatcatatgatagagctgaaaatagtagtccatcttcactaagcccacctggtgtaccttctaagcttaacatgagtatcaatattcatgcatacatagtctcctattgtaatgctttgaatttaacatatttcatatttagtataagtaaaatagtttataatagcaaagaccttttaaaattattttttttcttacttgctttgcacatatgaagctttgatttttacattttagcttctttgtggttttattatctgaactgtacatttgactcatttgagcaaatctccttacaagctagaatatttaagatgcatctgatcgtctttcagtaattattccagaatatttattcatcactgactctatgtcttgcacaatatatatgcttttaattaggccatgtgttacaatcacctgaagatttcctcaagcctaaattttaatcaagcctgactccaaacagaataactagagttttgaaccaggggaggggtatgtttttagattcccaggtgatcctaatttgcattcatggttgagaatgatctaattcaagcaatgcttttttaagttaaatgtattcttcagctatttgttgactatttctggtattgagaaaaatgaggatgatatagtcatggtgtctgttctttttcagtccacattcttgtcaattaaaaatattatgaaagtcatacaactgtgacagagaaatgcaaatgtatttctccaaacttaaagcataagcgtcataatatttcaaaggaaacaagaaaattctagtgatttttgaattgatattccttttctccctttccagctgcctgctacctagttcacatggtttagtcacaggataagagaaaagttttcaagcattttctacagatgtgaatgtttgatataaaaaaaagacactctggtttaaagaatgttgctaggaaacacagtttgaagatgaactcccctacagagctgtcttccatcctgtaataagaaagtgtggtggtagcatgtcctcatttaaaagcaaaaaaataatctattaactgtgtatccagagggaacttgttacaggcttatttaaaacttatttggaaatagttttggtttattatatgcaccacaacttccaggaattcttttgttttttaattggtgcaaggataaagttgtgagcatataatattttgtccaaataatcactataagagaaatgcacttaaatacaataatgaactcatgttaatttttgctttaatagtaatttctattaaagtaatatatcctttatcataggaaaatgtggatatacaaaaaatatgctaagataataaggactgcccataatgccacctaagagaaataatcatgctttggtgttatttatgttttatttcttctaaatactcaaggcatgttggctaattgttgttataggtttgttctgacacactgccatttagcaagtaaaacagtttaatccacttatatttattataatttcttatgtaccttgatgtatttctaaaatcttattttatgttcttttaattacccatttttttctttttccttattttctgccttctatttgattagtttatgtaccatgtattattgaggtcataatatctaatatttagccctgcattttcatataatccagtataagcttttcctgattctgattattataaagcatttgaaagtgtaattttaaggcttccctaatatttttatcatattgctctattatatgtaaacacatcaaattatttaatcagaatagatttctctatgaggaatcactgtatcaaagtatctgaatacttttaagatacttgatgcatattactaaattatttcctgaaaatgttgtcttagttactacttcttgtagcagtataggaaaatattaatcattgcatccacataaacatcgagtattgttaattttaatgctgtgcaaattttatcaaataaaatatatatacagcattaagttgcattttttattcatatgtcatacatgtatgttcattcatgtaagtttagcatgttctttattcattagtctattagtattataatagtctttcatatattaactgctgtgagttccttatagctatgtctgtaatctttttgaagttttttcccaatttacattttgcccttaaaattcattcataacttttatatatacaacttaaattttttcctttgtattttcttatattcagggagttggtgtatttatttcctttttaagtttctgtaagttaatttgatttttatattttgacttttaattcatctgagtttttgttgatatatgaagtgagattagaatgcttattgatttttttctagctatttagttgcctcagtgccctttattgagtcgtatttcatatctttacctgttagcactttcacaaatagaggatgcaagcaatataaatgtaagcctggtttaaatcttaattccaccacttactagtaccagaaacaccacaatcctgggcaaattgcttaacctacatgactcaggtgtttcatccctaaaatggacacaaagaagaacctatatgaaggtttttgtgaggggtgagataatacatgtaaggtgtctggcacacaataaatgctcagaaaatgttagttcttatagaatctgtttgttctgtaaagaacaccattttttatgaagtttttattatgattttcaattggtgggattatagttattttattagccttgagaaacaatttggtagagtacttaagcacatggactctagagctaaactgcttggttgtgaatcccaacatgcctactagttaactgtgtgaccttagctacttcacatctttgtgtctcaatttctctatctgtaaaattgagatattcatagcatttaccatagagattttctgtgagaactccaatgagaattaaatgtatttacagtggttagtagtaagtgctatgtatgcattagctataatttgttccaaaatagtcttaatgtccttttcaaacatttttcttctctaataaatttgagacttattctttcaagtgtagagaaatcccatttgtgctttgattgaaagtatgtcattttggaaaactttaagaatattgagtcttgttatcaggagctggtatagttttccaatttgtcaatgcttcttttaagtctatcaataaatatttatagcttttcatttcttgtactgattattaaaagtatttctaggtcatcaatcgtgtgtttgttaatactgcaggctgaggcttcacctttcttatttctaagtagacattgttagtacaaaagaaaactatagtttagtttatatttatcttctgcttagtcactttgctgaactcttaatgttcatattttatttaaatccattttctttgatatcctggtctataatcataccgtatgcaaaataatagttctgcatcctcttttttgattgttgtaaatacaatttttgcttcattttgaactatatttgcctaagctccaaaacagtgctaaattctgtgtttccagtatggtagaagacactgggataaaaaacagaccagacagcgatgggccctgtcttcacagtgttttaaatctattcccatggacttaacataatattgatctatcaaatcctgtgtgttggtttgcattatttaggggagatgttatataaccttcattagattattaaaagggcttatggctgtaaaagttaagagtcttttatcgtagattctggatattagccctttgtcagaggagtaggttgcaaaaattttctcccatcttgtaggttgcctgttcactctgatggtagtttcttttgctgtgcagaagctctttagtttaattagatcccatttgtcaattttggcttctgttgccattgcttttggtgttttagacatgaagtcattgcccatgcctatgtcctgaatggtattgcctaggttttcttctagggtttctatggctttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggcttgccaaagatcagatagttgtagatatgtggcattaattctgagggctctgttctgttccattgatctatatctctgttttggtaccagtaccatgctgttttggttactgtagccttgtagtgtagtttgaagtcaggtagcgtgatgcctctggctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcctagaatttacaagaaaaaaacaaaaaaccccatcaaaaagtgggcgaaggatgtgaacagacacttctcaaaagaagacatttatgcagccaaaaaacacatgaaaaaatgctcgtcgtcactggccatcagagatatgcaaatcaaaaccacaatgagataccatctcacaccatttagaatggcgatcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaacgatagactggattaagaaaatgtggcgcgtatacaccatggaatactatgcagccataaaaaatgatgagttcatgtcctttgtggggacatggatgaaactggaaatcatcattctcagcaaactatcgcaaggacaaaaaaccaaacactgcatgttctcactcataggtgggaattgaacaatgagaacacgtggacacaggaaggggaacatcacactctggggactgttgtggggtggggggagggaggagggatagcattaggagatatacctaatgctaaatgacgagttaatgggtgcagtacaccaacatggcacatgtatacatatgtaacaaacctgcacattgtgcacatgtaccctgaaacttaaagtataataataataataaagagtcttttatcctaatttatagtgataaatcagtcttattaataacccgattaatttttgtgatgatttatatgttcttattcactgttacggactttttaaaatttcaaaataactgtgatagtgttacccatttccttatacgtgtactttatatatatttctaattacccatattctcaaaaaacaataactaatttttcatagagaaatgttaaaatatgtcgaaaataaaaagactttaggtacattaatttacatttttaagagtcttattttgagtgttcaaaagtagtactggaaacataattcagtctgtaatcatggcttggtcacctatggtttctgtaaacataaatataaatacagatatggtttacaatcttaacttgttttagactcccgattacaacgtaaagaaatgtgattaacaacaacaacaaaaaaaggaagtatatagaatttggttttcttttgccaggaattaatctttttgtggactgcagaaatactggggaaagatagctgattggtaggaaagacagcaaggtgtttactgggcctgatagagagactacgggcccattttatcagtttaataaacagagttaagagtctaacaagctgggtggctttccacaaacaaaacaagtttgagagttgcagcaaaaggaagagatcctttcccctgatttagcatctaggagacaaccattcaaaggagggatactcatgtaaagaacacagccttgcttcccctcctgccactcggttcactccacagcgtcttgccagtgggcgttcaggcctgtgccagggatgcgctccatggagccagtcagcagaaatctcttgaaagtattttgactgaagctgtaaaaagttgaaccatttgaaaattccttcccaggttattctctgtaagggttaaacctgctgccttgggaaattcacttcctatctgtatacctgtatttatagtgggagggagattctttaataggttggtgagaagtagctgggcctataattaaaatcactgctctttattaactagattttagccataatgttgagtggaaaaaacaaagatgggggatgtgataagtgattagaaagaaaacaaaacaaaattgttaagagtcaaatatagtggtccagtttgaatggaattgaaggaaagaaaaggggcaattggaatgtcattgcttctcttttcagtctcttcaatttatccctttacatattctgtacaaatactaagcaatttttttagataagtggcatagttataactctcaaaacaatttgctaatttatacgttcaggaatttaaaaactgtttactaagcatttcccatgtgataggtgttgtggtaggttctcgggtttttgaagccccaaatcaatgggagagtcagacactgagaattatttaatcataaaatgtaatactcatccttaaagaagggcagaaatggtataaatctcaatgtattattatgagtattaaaaaaagataattcacataaagaactggcagtgatcgtggcagtttacctatcatatgtactccagtgatgagaagaatcatgaagacgagcattatgctgaggatgaagatgttaggggacaggtactgccatttattatcattggcaagctgcttgacttctctaaacctcatttctcgatgtgttagttggagtcaataatagttacctacacgtaattttgaagattaaaggtatttgtgaaccaccggtatttgaaacagtgggtgttctataattgagttatttcctttactagactcctatccatgcgatattaatctctaatactatatggatattatcaataaaaaagaaatacagatacatgagtggtatattctgagaataacattagatatggactatctctaaggtcatttttaaacagagcgaatatcacctttcctgtgactccccactgtactttatttctccttataattttgttattttttaatagactttaagagttttaggtttacagcaaagttgagcagaaataacagcgagttctcatataccccttgtctcctcacacatagcctcccccactgtcaacatcccgcaccaaagtggtacagttgttaaaatcgatgaacccgcactgatacattattatcaactgaagtccttagtttacattagggttactcttgctgttgtacatcctatggatttgcatgaatttataatgatagtatcatacagaatagtttcactgccctaaaaatcttctgtgccactgcattccagctctgtgatctccctattcatttctccctccttgctaacccctaggaaacactgattattttactgtctctgtggtgttgccttttccagaatgtcatatagttgaaatcatacagtatatagtcttttcatattgaattctttcacttagtaatatgcatttaagtttccttaatatattctcctggcttgacagctcatttctttttagtgctaaataatactccatggcctcgttgtaccacaggttatttattgattcctctactaaaggatgggtttcaatttttggcaattattaattaaggtgctataaacatccttgtgccagtttttgtactgacatacattttcaacttctttgtgtaaatactaaggagtgtgattgctggatcatatggtaagaatatgtttaactctgttagaaactgccaaactgtcttcccaagtggctgaaccattttgcatttctaccagtagtaaacgagagttcctgttcttccacatcaaatgctagtgaggatatggaacagcaggaaccaacaacatttggtgttagatttttgccatttgaattggtatgtagtgatatctttttatcattttaatgtgcaatttcctgatgatatatgatgttgagcatctcttcatatattgatttgccatttgtttatcttctttggtgagatgtctcttcaggaattttgaccgttttctagttgagttgtttgtattcctatttttaagttttaagaatttttgcatattttggataacactcctttatcagatgttttcacaaatatttgtccctgcctatggcttgtcttctccttctcttgaccgtgtcttttgcagagcaggaattttaaattttaatgaagtcctgctttgcaattctggttttcatggattctgcctttattgctatatcaaagaagtttggattctgcccctattgctataccaaagaagttatttccatacctactttctcctaggttaccttgtaggagttttatagttttgcattttaaatttaggtccctgactcattttgagttagtttttgtgaagagtgtaaggtacgtagctaaattttttttgttgttgcgcatggatgtccagttattttaacacaatttgttgaaatgactgtttcttaattaaattgcctttgtttctttgtcaaaagtcagttgattatctttatatgattctatatttgaactctctattctgttccattgatctatgtatctgtatttttcaccagtaccacagtatcttggtgaccatagctttatagtctttatggctttaagtcttgaggttggacagtgtccgtcctccagctttgctctttttcttcaatattttgttgactattctgcttctctatgtaaaccttagaatcactgtcaatgtaaacaaaataacttgctgcagctttgattggaattgtattgaatctgtagatcaagctgggcagaactgatatcttgacaattttgaatttccctcactatgtttttatctttgtgttttacctaaatatttgttcaaggaaagaataatttgaacttttccatactagagccctgtctaaaacgtttaccctctttgctatccttagttttggtcaaataactagttggctgtgaaggctgagcaaagatctaccactaagaatttgtattgtgagcctgtctgaaggtgaatgatgtatagactggatgcgaatagcaaaaagtgataagaaagacatagctacagtggaaatgagcttctctcagggtctaaaatctgttactctgcatactccttaaagtgttgctctcaatggattttgtttgtttgtttgtttcgtaaaataatatgtgtattccagatgaatccaggaagtttctcattctaagaaaaacactaaatcccagccacattagaatttttccatgagaggctgtattaggttactgactcctattaaaataaaaatattaattacagaaaacaaaatggaatcattcccaaagaaggagacacaacaagaagagatgaaaaatcatagccaaacaatcattatcactggcatatcggaaatagtacctgacttagttaagatattgtgcttcgacaggaatgctaatcatgtttcaggacataacttgtccaaaaactatatactcacagcttccggaagggaagtccacttctgcaagggcaagagatttgaaacctgaaactttgtaatttttttgctgacagggttggagggtgatttgctaacatctcattatacaatgtatgttaagagaaatgtaaaggtcaaaacatggtgctttttgtttctgctggagtgctcagtcagagagattcagttcagcacaatatcaatcattacaaattcttccccgaaattcaagacacattaatcaaaacaaatggaactcaagaaaaatgaaaactggggggggtgaataaacaaatacatgattgagttgaaaacataaaaatatttattaaaataccaaaaatattaaatagaaacattctgatgtaatgatttctgatacagttcaaacttaaataaagaatgtatggtcacataaaatgtaagtaagtatatcacctttcacctaaagttttccagttaaatgcaaaaccttcctctttaccctaactaggtagataattatatcactctgcatagtcatgttaggagtttaattttcaagctaaatcaaaatcacttaaaatgtcaatgatagtttaaaatttaagaatagaaatttggacatatcaaactcaaaattgatgctttattgaaaaaaactaaatgtctttaaattgctataacaaactttatatgttcaaaattagttaacaaaaataaaagaggacaaatttctgcattcttcaacctccaaatttctaatatctttattctaagaaactgcagctattgtagtgatattccttcaatcctgaaaacactcaggaagcaattttttttaaatgttttaccttggcaggaactttagatcacaagtcaaaggtatctcttctaaacttgtaaagaaagtaaacaatctaccaagagaacaaacagctcccaatagatacagctcttactgcttcctccccttattttgtttcttttagttagagagccatgacaaaggaaaaacaaaataatttcagatttatatttctgttgcttcttttttcttccttccattttgttcattgcataaaacaaattgattaggaggttctcttgctgggcttcaaatatcattaatatgtagatgacttccaagtagctatcccccactcctgtctgacttctaaattctggtcttatttattcaaatgtttacctagtatctccacttgaatgtctaatgggaaactcaaatataatacgttcaaaactaaattattggtcaactcactttcccatcaaaactcaagttcccctttgttgaatagcaacatccttacactctaatagccaccccaaaaggcaaacactcatccctgaattcctcccttttcctcattgtctgttccaatatctctacaggtactaagcagtcaatgtttatctttcactggttcataccctccttgaagccaagaaccatatttcttggatctgttaaatccctaggacctttaaagattttaaaacaaataaaattacctatataacagcttcttcatttgctaagcaaatgattacttttacatacctacattgcaagtgatactggcacttcactgcattgaagaagtcactagatcttgaaagataagctctattgtatccttcctcccaattgttaaaacccacagcagatatacatgaagagtgaatgttgatttaaactgtgaactttagttaataataatgtattaatattagctcatcaattgtaacaaatcgactacagtaacgcaaaatgttaatggagaaactatacaggagagaagggatatatggaaactctctgtactttctgttcaattttctttaagtctaaaactgttctgaaaataacatataaaatatgtcacagaaaaaatatttctctcattttatgccattgtattctcaagacatctagagacccattttttctccagtccccaatgccttgtcttttaatacctaactttttatttaatattttatctattagctgagtatatttcatttcccttcccacaagtgaaaatagataatatataatgctggcttcatgaagacttatgaagaaatcaattctatgaaataaaaatatttctgaatgagtttattacaactgagtggggaatttgagtgtcatttctagagaatttggtccatataaattcagtcttggcagctagccattaggggtttttgaactggcatatttgagaagtgttctaacttctcagtggaataaagaagaggggaaagaacattatagaatgattcttttctttaataaatttccatataaaagggttttgaaagtctggcctcaaggtaattccagaaatagatttcaaagactgcgactcaagtttctgtgttatagtaagcttaagttttataaagtgtcaaattgatgatcagttatatggaagcctctatttataatagtatagtccatttttatactacttttaatttgcaaaggtgctttcatatattatcttatttggtattcatagtcatcctgggaaaattgtagaacagatgctaactcctaaatagataaccacaatttcacaaagtaaagaaaaagaaatgcatggaagtatcctcagtccaattttatcagtccattttctattgcttcaaaacacctgcaactaggtaagttataaagacaagaaatttatttcctacagttatggaggctgagaagtccaaggttgaggggccatatctggtgagagcctccttgctggtggggactccgtagagtcctgtggcagcagcaacacagggcgtcatgtggtgaagggactgcgtgtgctcgggtgtttgctcaggtctctcttcctcttcttgtagagccaccaggcctactcccatgataacccatgaatccattaatccatgaatggattaaaattcaatcacctctttaaggtctcctctttaaatactgtcatgttagggaatgtttccaacacatgaaatctgggggacacaagaaaaccatagcaccaatgttaaccatttaatagtaattcttgtgcttcaagattttttttttttttttttttgagacggagtctggctctgtcgcccaggctggagtgcagtggcgcgatcttggctcactgcaagctccgcctcccgggttcacgccattctcctgcctcagcctcccgagtagctgggactacaggcggctgccaccatgcccagctaatttttttttttttgtatttttttagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgcttttcttttaattatcagctctattctaagacacctaaatcttctgaacacacacacacttacatgctgacacacacatgctgacacatgcttacacttatgcacatgtatttattaatcacacactgtgcaaagtatttaagccccaataggaatataaagatatgtataaggtatgtttttttttccctctctctcagaaacttatagtatagttaggggtaaagagaaatgatcacaggtatcttacatacattttttatataattctcagaagtatgtattatattactattcccattgtacaaacactgaaatgacttgcctaaatccactgagccatgtgcatcacttctgactagactcacagtctgtacccttgtctcctagcctcactgccttttgataatataaacatctaaaatgctatgaacataggctcagatttcctaggacagttttatagttggttattgtgttctatttattgtccattaagacatatcagaaacaccaaatttcgacaaagaaaatacttctccaaaatactttctttcctcaaccttttaagttgtcctcaaatatattttttctaattcagtttcccaatattcaactggaagtggccttgcatttaaaaagtaagcaagaatataataataagataccagcaggtgagacaaaggaccacttgaagatttttgacaagggagaagacctcagaggaggaggttgtctgaggagacactttcctataaagataaaatttaatctggatcctgaaatagagttgaaattcttattttctcatttacaaactgaagctaataatagtagctacatcatttgtttagatgaaaattgagttaatacttaggcttttaaaacagagcctgacttagaagttggaagatggagtacatatatcttaactactaagctaaatgtttttatcttttaatttctattgcctagcataatgcctaacacataaaagtatttaatagataattgttgaatgaatgatgaaatgatagtgtatcattggtaaattttgagtcagagagtatagtaagagaattatagtttttggaggtcaaattgacatttgtattgttcactaagcttcagagatttggatatatgttctttacaataataaatgcttagactgtttcctcttggtggaagggatcaaaaggtagatccatcaagttttctctaaagcttctgcctaactaggtgctaagcttttgaagtttgagaatttgcttctactgttattactaactggggcttgtatgaagcatttcacatagcaggtactcaggaagtattgattgattgataagacttggatttgatacaaggaaatagttgcttacattcagggagaataattaaagataccagaaactatagaatcactttcctttagataccagtttttgtataatatacatctctttctgtaatttcatatgaccggaggcatgtattgacccttgccctactgacaaattaattaatatttgatataaattcgaataaaaaggaacaaagctctctgtatagcccaagaccgtgttgtggatataagtctgaaacctcaatggtttgggggcaccaggttaaggtagccccgtaatttccccagtatctgttctggtaatgaaacctttaaaaggagccagaagagcagagccttcataaaccaaagcacttaggattaaatattatgatgatattttcttgtagaactattcaacaactctctgtgaaagaaacaaaagttcaacacatggcatttaaggtgccatgattttaacacacttctctttctcaaatattttcacgagtatatgccctagccatgcttattcttcaagggtctctgaatttgacctttattattctcctttctctattgctacttcctcctggatctgcttgccaagtatggaacaataatttgtttttagtaatttctcaataaacatattcaacagattttaatggagtatctttgatgtgttaggcatcatgttatatgatgtggggggtatagaaaaaggaatgagataatctgctgttgaggagcttgtaatttagaaattccctccctgaataaatctctttgatttaccagtacttatgctactgctacaatatgtctggacatggtagatacttaagaaatatgtatgcaataaattaataaataattttaaattaccattcatcttcccttataggattactttgttatatattcttcaaagaaaatgtaatgcatttcttggtcttcgaacgggttttgaataaaaacagatgtctgcatggttaaattgcacaatcattgagattaacttatatatgtttcaaatataaatacttgaacagttttaattgaattgaagtgaatttaacataaaattctcttatgttctttctagaaatgagggcctaaataattttggtatgaatcacttatcagtttaagtactgatacaatgacctgtattcaatgactcttttacctaaaaaacagaatgtcaatgattacatcatgctcccaggaggactgtaccttccatgttgacgtctcttaatctgaacagcagctaataggagttatgagatcatcagtctcattctcccttcaggggtggtctcgtgtcagaagacactcagaagttttgtgtacctttagatttgtgaagtggaataaatgcctgatattttaacaaagatattcagatactgtgcagcatgcagcagcctcgagcatcataatcctatgcagcagcattaggtagaacgacttagagtggaacctcagaaagcacagtggcagcagtgatgaagccttcttattagatgtgggcatctccacagtggagtaaggccatacaaagggattattacagcacaggaagtctttaaaactctcagggtacattgagtgagctcttggatctggcactatttctttacaggtcttatccttttatgcttatatgtgagagcaaaagagaaaggagtttgaacattctatcctgctgacataggatttttttctgctgtattaaattcaaaattctactttggatctagatatgattcacaggtatcacaaagcatatttcttttgtagtagtctaccaatctcagatcggtttgaattgcagttgagcaacaatggtagttaaaacacattcaatcaggtcattatcgtccaataagacagtctcacataaaagtcagaaaccttctagttattagtcaaagcaatacatcagaatgccttgtttattatgatatggcaaaatgaatcagatgtagacatagaggatatttattcatcatgtagaccaaatgccacacaaaatataccatagacataattttaagagacagactattaaatatcatgcatcttctaatttttagagatgtgttggctgaacgtgtggccctggaacacatttgcatgcacatagatacctatacattgttctctgtgagcaacgaaaatattccaaccttcacttaacatacttactacgacaatccttgaactttagtatgcctacaaatttcccggaaaacttgattaaaatgaaaatattaagactattcttcaagagttgctcagaaatcgatcttaacaatcacgtgccaagtgctgttaatgtaggtggcccttggaccacagtttgggaaacactgacttattgttatgaaaaatatgttaattattaaatatgcaaaatactggttttttaaataatctaaagcaaagacagatactaagtatcttttaaaaaaattaagtaataaacgataagggatttaaatctgtacggaatagaaacccttgctctgtgctctgttactagctatttgtattagagcaatccatgtaatccctttaagtcagtccatctctagaaatggctgctgaggagaaaaaaatcttaaggctttgacagatatggatgttaattaagtgctgacaggacggcatgcattttacagaacaactgactgcttacatttttgtataattggatttataattaaattaattgctcatttatttttgaaatgatgtaatgcaagcagaggaatgtaaaaatagtgaaactttatttgtgatatttatagcatatatttttactgggataatttaagcccatggtgtcacacaggactataattgctacagccacacgtattccctggaatttcaggaaaccatcatttttaggtggtagcaaaaataggaaggcccacatagatttttgtcctacattttgggagtgtgtgtgtgtatggttaggtgccttgtaaagtttgagaaaatgcagaaaagccctgctgattccaaactatcttgcctgtggaactgataaggtaccaactccacacagttattttgcttagaattacaaaatttgacatgctaatggaaaatggagatagtaataatgaacaaatcaagtgatattatttcttgcttatcagcaatgctgagaattactgattcaatcaatgaacaaaagaggcactgttttagcaagcaagatttagaactcacaaatgtatttacgagattccactcaacctctttcctatcagtatattaataagaatcagtttattactcaagggcaaagctatattttaggtttggcaaataattgctgcttaaaatattaaatgaatattaaaggaaagataaaacatggtagataggtttcagtaggagttgcaaaggatgaggggatgtgaaactgacaaccgctctgttgtcgatgatttacatgaagaatctgtgtagaagagattgaagggagccaggcaattaatgggagtactgaaggtgacacagtaacctcagatacataaatgcagtaggaagtaacaagcatatctgcttaaaatcttataagccactaacttgtacattttcgtatctgatcctgaccaaatctctcacatttctagagctgtactgagttaatagggatcgtgtagattgcccaaaaatgcatagctagtaatacagccagggtttgaatccttttattctagacacatttaaattctctatgttttagtagttttttaaaaagatatttaaaatccgttcttgatctagatcataaaaaggattttttatattcaaaaattagcatatttttaataacgctaagtcagtgttttccaaaatgtggtccagggtccacttaacaccatttggggtgcacttgttaattagacagattcctgagtaaatcgcaagataataaggatttctatggaaatagctcaagcatctgattttaatcaagcttcctaagtaatttgtaggcatactaaagttcaagaattattgtagtaagtgtgccaagtgaaggttggaatgtttgatactctggggatgttacatttcatgagatgttttagaatgtgttgtattgctcctctttcatgtatacggcacacacattcaagtgacaggctgtttgaggggctaaggctgttgccatctgaagaccaatgcagctctatctgctcattgaacaacatattttattctgacaatggaaggatactgtttgtaatcatttgcagaaaagggggtattctccttgtgtgtgtactgtattccttggcttagaacagtatggtcttcagaaatttttatgaaatgtatttgaccactgcaataagctgcttaaacattgttaatgacttcatagaaaatggttagacttttgtttatagagtgtaaagaaatcagtgtgaggctgatctaaaacataccattagtcagttaaagggggtttcatcacctatatttaaattgtatttaataatccaaaaattaactggagagagataatatttatatgaaagtgcttaattgactttgtatttcattgtatagtatccccttttaaaggggtagcaattttaaaattcaaaactagttttatttccagaaaatttcatgtattcgtttcatgcatttcacttttatgtacatatgctgcaaagctttacatccacacacacatatccatatacatgcattacctaaacctcacaataacactcttagtaggaacttggatcttcattttaaagactgacacctcagaagatgaagggacttgagcagcagaggaagaatttcagatcgagtctgagaggaaattgtccctcagttttgaattgtagagtaggagatattggtgtctttttgtctggaataatatgtgcttaacttgaataagcttctgataatctcttggaaatagaactttgtagtgaatgttgttcaacatcaaattttaggttaaatatttttttaaaaaatgaactttcacgaggttgaaatagaggtacaatttatggataaaggcacatttttttgtacctgatgtgccaaaaaattttttttgtaaaagtgatatgaccatttgctgatatatatgaatatttcttcaatattcttgagatgttctctgtcaatgtaaatgattgtctaatcatcagtgcgatgaaaagctagtttcatttgtcatgatggaacacactttcattacatagcagtactaaattctttgtaaataatagttgctaatatattgttgaagcattttataataatttatttggactatccagcaccagaataaaacatgacaagagctagatggaggtctgtccagcagaaaaatgcatatctagatataggacagatttctcaaatgagaaaaccctagtgttgtctaaaggaaagagggagcaggaagaagaatgacaagtagaggaagagagaaggagaaagaaagacgaagatgtgtcatactgccttgccttactatattgagaagtgctgttgttttaaaatatgtgtaagagatttagtaaaggatgctggagaacagaaggtgaattctcctggaaattaacagagtgccagtccatgtcagggatccatcagtcatggagacccacagagctgcatgaggttgtgagatgcagcagcagcagcagcagtacctggcataaggcctggctgggtgtacaagaggtcacagggctctgaaggctgacacgttcagggagctggccagcacagcatggcctcaggaacaggaatgcacccccagttcctgcttctggtccttctgttatttcagttgttgagaagaaacaagtctgctcctgtgactggcacatgtttgtcagagttgcttttttttttttttttgcctctgtcacttcattttttgcaacactttcaggtccatggaggtcagggggctagctgtgaattactaagtggtgtggcctcaagagagaagtagtaggggcagtttcttccacattagtaggatgggctcagcttgctgccttctctactgtgctgctgaaggatgtgatcagagagtcacaaatgatgggataactggtgacacaatagaacagatcaccagcagaaaaataaatgtgtgaacaacatatgaaagatacttttatacccgaatggcaagaaatctatatcataaaataaattacatgctgctgggggatgtctcactgtcctaatgaaagacaaaacattttgaagtgaaggaaaagatagcatggaataacacagagaggctcaaaataatgaaaataacttttcattctgattagagtgtacatattcagaactggaaaacagacttccagtaatgcccaataaaccacatatttcaaaatgcttttaaatattgatacttaaaatatccttttctggagtatatttataaactgcaggaatccctaacaaggatcaaagccccagtaatagacattttctttccttctttctttctcgtctcttctcttctttttgagatggagtctcgctctgtcgcctaggctggagtgcagtggcgcgatctcggctcactgcaagctccgcctcctgggttcacgccattctcctgcctcagcctcccgagtagctgggactacaggcgcctgccaccacgcacagctaattttttgtatttttagtagagatggggtttcactgtgttagccaggatggtctcaatctcctgacctcgtgatccgtccaccttggcctcccaaagtgctggattacaggcgtgagccaccccgcccagccctcttctctttttccttctccttcttcttctttttccttccttccttcctttccttccttccttctttccttccttccttcttccctccctctttcattctttctttttttttcttttttctttctttctttctcagagtttcactctgtcacccaggctggagtacagtggcatgatctccactcactacaacctccagctcctgggttcaagcaattctcctgcttcagcctcccaagtagctgggattacaggtgcatgccaccatgctcagctaattttttgtatttttactagtgatagggtttcattatgttggccaggctggtctcgaactcctgaccttaggtgatccacccacctcggcctcccaaattgctgggattacaggtgtgagccactggacccagaccctattcttattttaggaaattaaagttcattttggataggattatagttatgtacatggtccattcatttcatcatttattcaataactccatatcaagtgacttctgtgtgtcaggcattagcgccacaacaatgaacaagatatgtatcccctgccctggttggcttacagcctaatggaataataaatggttactgaatactttcagtcaacattttgcatgcacaactttatgcaaaccttgcaattgtgctatgaattagatattctttccatattaaaaggtgaagacaattaggttcagaggctgagtaatttgcccaaagttgcaagctaaagaatggttgagccaaaattcggcaagatatggctaactttccctgtacacatttatgcattttggcacatgttcccatatactgtggtcattattgagaaggaactgttaaattacattctagccctagaaaagttgtctgtattttattttcaatttactgagatatcttgctgtatgtggacacaactaatctttttttaggcctatcccacttctttccagattatctatacagttcatgggtaaatagaccaaaatatcactgatgtactctatcaaaatgaaaaataagaagcaaactttcacagaaattgctcttaattcttcacctttatttatctgtttctttttctctctggtcagtgctgctttcttgcccctcaatagcaacactgcagtagcatctcttgctcttaaatgtgaatatctgtgggaaacatttagaattctcaaattataacagtttattattacacaaattaagatttcactctgtcactcaggctggagtacagttaggattacacaaattaggatttgtgtaataataataaaattaaaaataaaaataataatatgtcatctaagttaatttttacaaagtcaattgcttgattggcattaaagttttggcatttttatgtgtttgctttttctaactttctcttcattaaaatataacttgtcttattttgtatgtgtaactcaatgagaaaaattagaaactatcaggacaaaaaaagtgatcaaattcacatttttgtgacaaagtttagataggcataaccagtgtgtacacatttcaaaaattttcacttaagtctatatgtagataacgatgtcatgcacaatcaaaataaaaagctaaaaatctttccacagatcatgtaattgattttcctgtcctctaaaagaattgttggccgggtgcaatggctcacgcctgtaatcccagcactttgggaggccgaggcgggcggatcacgaggtcaggagatcgagaccatcctaacacggtgaaaccccgtctctactaaaaatacaaaaaattagccgggcgtggtggtgggtgcctgtagtcccagctactcgggaggctgaggcaggagaatggcgtgaacccaggaggtggagcttgcagtgagccgagactgcaccactgcactccagactgggcgacagagagagactacgtctcaaaagaaaaaaaaattgcttttcattcttcacctctattaaactgtttattttcctctctgcccaattctgcctaggaaaataaattaataaaaatttaaaatttcaggcttatatatattaaaaaggaaaaatatgtttatcctggcccatatattaccatggtccaggtaaaaattttgtccagcctctgccaaatgctaggattcttgcaaatcagggagtatatgtgttctcaaaatccattaaaaaataaatagactcctatatttttctctgacataatagtatggtgcaagcaatcagtaggattttaatgttgctgttttaaatatgttcgactatatttatacgttgaacactacaacatgtgttttccttttaaaattgtttttcatgctttttttttgttttgttttttttgagatggagtttcgctcttgttgcccaggctggagtgcagtggtgtgaagatctcggctcactgcaacctccacctcccaggttcaagtgattctcctgcctcagcctcctgagtagctgggatacaggcatgcgccactaagccaggctagttttatatttttagtagagatgggggtttcaccatgttggtcaggctggtctcgaactcctgacctcaggtgatctacgagcttcagcctcccaaagggctgggattacaggtgtgagccactgtgcccagcccatgctctatcttaatttatgttttcattcaattctatgtcatgagatttcagttatgctattatatattcttttaaaacaatgatttaatgtcttttcaagatgaaacccctattgtgtcattattgatgagtgctctaatgccctaggccatatcattcttaaggtgatccagtaagcagtggttgaggcaggaagtcaccaaatgactcaaatctaagaatgcaacactcctgtataaggccctgcctaccgcaggaaggcccattcccaccgtgctgtgtttaccatggtttcagtgaaaatgattaacactttttcacgtttaatagcatacaggtccacacaactatgtcattgcactggcttgttcacatatctgtgtactctttttctgtgaacttcttaagagcaagcaaactgtgcctttcttttttgagtcttcatagctacatgcttagtcacagtggtggattttaccacggagatgatgaaacttaagtagcagggcccttcacctgcatgaggctattccagggtcctgggtgaaactttagcagtgtaatcacatggtcgtacatgattgcaaaatttttaaaagcaagatattttaattagactgctacatggttttgtattttcgtttatattagtaattttattttcttcttgtcctgaaagaaggctctccaaatggacaattttggccccacaaaaccttgattgtcccctgttgacatgcaaggaacacttatttgcttttttcttgaataagtgaaagaagtaaaagggatgaggaggaatgaatattttattaattaatatattgtaacatttaaaattagcatgtctggcaaaaattttccttaagccactaacagaaaatgctaacatcatcacccttgtgtaatgtctgtgagtttacaagctcttatacaaatgtaacttcaattgaatctttgaaccaggccttccgttaaatgtaaccttcaattaaagtgaatgatatcaaaatgtttacaactgtgctatttgtagaaaagacttattatactcaatggttacagaggaaaagaaacctaaacacatgattgagtgacactcatgattgcattgtgtcaatactaggatgtcagctgaagccttctgatactgactccagtctttgcattacacggtgtttacaaatatatttaaataaatgaaaacttattctacaaacgaaaagcataaagtcacataggttaataatgttttcctcaaatgatgaacatttccaatttccttccctttctttcttctcctctcctcctctccccttccttcccctctccttccttctaattctttccttcttcttcttttctttcttgatgcaggtgtttaaaattatccaactgccatagagctaaattcttttttggaaaattgaaccgaacttctactgaatacaagatgaaaatgtggttgctggtcagtcatcttgtgataatatctattactacctgtttagcaggtaagaaatatcctttgtatattctacatatattatgtcaacataattgatatgcgtgtttattaaatgtattgtatgaagtaaaaattcttattttctcgacatctgggtcagataagtagataaatatgtatcaagggtgaccctatttcctttttaatttcaattaagatttcacaaaacattgtcaatcttgggtaatagtgtgctggtgaatgtttaaaatctagatctctggggagatccctggagtgtagcatttgtctattactggggagtaaattatcctaccatggccagtttcaacctgacatcatttaatgtggaactggaaagatgtgcaaccgctcaccagtctgtagtattttcaccaccctgatataagtaaccacaatggcaaagagaatataaaatatagtaaataaaagagagaaaacaatgggttttaagcatttattccctttgttcttagtataatttattcatttgtaaattaatacaatttttaatactggccatgtttaacaactgattcacaaaatttctgaaaattaataatcacttcttaagagctataagcagatgcaacacactactgaatcttacacaactcttttgccaatttgatcaatataatttaaaaaatggattaaagtaatctacagtgtgtgtagggacataagactaataaaacaattttgagagtacattcattttaggacaaagaaatattatatttctgtctttcaaaggcaagtgtgaagcattcagacctatttcctacaatgagaagcacatcatatctttatctgaaaaactgatataattacccaactagtacttattgagctaggtcatttagtacttattgagctaggtcattattatgaaagtattagaaaaattgaattctaacaaccaatttttctaatactttcatgataatgacctaacccagtagatacttgttgagtgactgttttgttcaagacataaatggtcctcatccttttgtatataaatccccattgatcactttaatgattaatctgacgggcatcattattaagaacataaaaaaatattattttattttggggaataatttttattatgctcactccaaaactcagaaaagatcatttcattagtacttaaggattttaatgacattgataaatatatattttataaccagggtaattatgcacacacacccacatacatagatgtaattacatgcataatatatttacatatatataatgtaaatataataaagaaaaaatttggtaaagtcattgtgaagtcttatttttgtgaataaaataaaataaaaattatcttattattactgaaaattcatacgaattctattgactgcaaacttcggtgctgcaactatcaatgtaaagataagaaataagtatctgcacagatgtgaagatacttcaacctttatagtaaagggccactactctcattccattgtctagcatctcagctatttaagtaatgtttgaaaccacaattcaaataattgcttcaggatcaaaattgttttttctttcatttttagagtttacatggtatagaagatatggtcatggaggtaagttgaccaaagagtagaccttgtaaacatcttttctctattgaatcatattttatctctgctttaaactattaactctctaaactttaaggcaaatggttaatgttagatcactatgaaattttgtaaggtggtctttctgagattataagcaaactgtttgttgaatgagtggatacatcataaacaaatatcctattagaggattgtagcaaatggaaaatattcaatttggctggctttttttcctgcatgctttgtaacaatgctatgcgactaaatttggaagcaatattttaaaatttgtaagccttgaacttatttttgaaagcctcttgctttgttgcaagggagataactaaagttagtgaaattggaatcttaagattcagttcaattaaaagtccacaggtattgcaaaatttattgtttaataatccttccagtttagagcctacttcaactaccaaacagatattgcagaaataaagtcagcatggtatactggaaaaaatacagagtctagagtaagaccagcctgaatttgcattttcagctcagtacttactagatgattttattatcttgcataaattatataacttctatgagtctcaactttccaatatgtaaaaatcacagaattgttgtgaggactaaaaaatgaattgcaatgataacttctagcataatgactggcaagtaggtgcttaatgagtgtagcaacactagtaacttacaaaagccattgcatgatggtaggagaatgaaaaatcatgaagaatcactgaacaaccagtgctagaacttgcatgccaaatcaaggttacccattgtattagtctgttttcacgctgttgataaagacatatcccagactgggaagaaaaagaagtttaattggacatacagttccacttggctggggaggcctcagaattacggcaggaggcgaaaggcactttttaatttatttatttatttatttttgagatggagtctcgctctgtcacccaggctggagtgcagcggcgcgatctcggctcactgcaagctccacctccgggattcacgccattctcctgcctcagcctcccgagtagctgggactacaggcacccgcaaccacgcccggctaattttttgtatttttagtagagacggggtttcaccatattagccaggatggtctcaatctcctgacctcgtgatccgcccgccttagcctcccaaagagctaggattacaggcgtgagccaccgtgcccggccgcaaaaggcacttcttacatggccgcagcaaaagaaaaatggggaagaagcaacagcggaaacccctgataaacccatcaggtcttgtgagacttattcactaagtattttttaaaaatagcctatggctgctttttccaattccttgacccatattctccttttaatctgctgcaatcagtgtttcccacgagcactcaacaaaaactgcctcattcatgtctctaatgtcacacattgtaagtccagtggtcaactctcaggcttcctacttaaccggctggcagcagtgctgcagttccaggtatcacacagagacataacaatgtcttgtaggcaaatagagcatgcttgttttttttcttgtatctatctacctttaaaaacaaggagacctttcccagaaaccttacactacatgtccagagttgggtcacacattcaccaacaagcccatcgctagcaagagtaatggcatcactccctgtcaacctttacgtctgagtcatgtgagggataggttgatccttgaactaagctgagctttgtcatgaaagtaaagggcagaagaggagctgattagtcaaccaacaatgtctgcgaattactcaggtgaattgaaattgagaattttctcacaaatgaaaaagttatatccaatatgtcatccagcatatataatagtttttaatgattattttacagcaacattagtagctagtgttcaaatatatgtattaaaacaaaaacattttaaatttgaaaaacaaagtacataaaagattataacaaaatcatcaaaaccaacttcactcaatgtctttaagaatatttttcttcttaatttttttttagattttgtgaaagcaatattgtattctattgagataagagagcaaatatgaataagttgcacataatctgtaatgtttagatatttaattaataactaaatcatttgacagcaaatattttagatgcttttttccacttgtagtctgcatttactttactttcagaaagaaaaaaaaaaacctgcagctattgtaggaccaacttacacccaggctaatctaaaatgaaaataagtatctttcattcctttgtaattcattgagaaaaagtatcttaaaaatgaaataaaatagcagtataatatatattttgtaagaattgggatatgaaataatatataatttatactttgtacatttagagttatgatatgactgtataatatccaaagctaatatttaaaaaaaaaaactatcttcattgcttagctgtagggaggacaggtagaacatttcatatatctttacagtacttgcaccaagatttcctgtatattttttcaactagactcacatcagtcagtaagaattattttcagtacatatttctatctctaaatatgattgacattttatagcagtcagtgacctgtctctattttgatctatggtcccacatagccccattaatcaaaatagactagagttagactgaaacaggccaagttctggaagtaggcccaccagcccagtcatgctatatattaggatgtagtaagacgtgaggtaggtgtcagaagatgcccagccaggtatgtaaaacagaatctagatgcttcagaggtgggtcacaggacaaggaagtagttcctctagagagatgtgacaggctccccttgggcaggtaaagccaagcaaggagaatttagttcacttaactttcatactaacctgactatattctttattctaataactgtatttctgcaagtttttgaggccaactccttactttgtatgtttagttataaaaaagtactgcaatgttacctattacccatgaccctaaaaaactggggcaccagagtgtttaaaggctaagcccatcttctgttatcagcaggaaatggttggcagtggagataggaagctgtaatatgtggaagaaggatgctttgtgacaatttaaatattatctcatttagagagtttcaagagagcttacaccactccccacccaataatcactgtaacactgtaaatgtaaaaatttccattttagtcttttgaaattttgatgccattacctttttctaacagatttttcctaggactcttcttacaacatgcttatgtaaaattgtgtttactaactaacagattgaggtgacatataatagactgggaagtggagtttgtctcaaaaagtatataaaatgaatacaaatatctctgaagtacaaatcataattttactttcaattcctggaagtaaaatagaatagcaatattatagtggatactctccacatagtggtaggtgaagtaatcccatttgagattatataagtgactaattatattaatggcgaaagtgagaatgaaagaacagtagcttttgcctctcatttacattagtaaatatgactgcaaatattcttacattatttatttctatcttagtctttttgatcacatttaagaaatgtacttatgtctgtaatagatttatgataatcacattatctggtaggaaataaatgtatttgcattaaaagcagatcaaaatagtgatatgaaatgttaaagcttcaattagcttgagaggtcatctataactttgtgctccttttaagaagaatctatctagtaaaaaaaaggaatgtattaaaaaataattttagtttttaaaaacacaatctctatctgtggtttgtttcttatgccttttaacctcataatacttccaaagcatcaaaatttgtcatctaagtgtttccatggctgtagaaaaaaatcaatagatgacagtattttctgtaggctgagaacataatgcttacattactggatcctttgctgagctttgtattgaaatatccctcaaaattcttctccctgcatctgagcaccctagttgagctagcgtggtcggaaactaaggtacagcctgcgagggagacatgaggatcatattcaagaggttcatgctgaacctggcaatgcaatacagatgcttgttttgagtaatgtttctttcaagggcccaaatatgttcctaaaataaaatatatacagtaatttctaaaccgtcaaacaaaatacattatgtgactcaggcttgaaaagtttagaaagcaagaagaatatagttatgaaataaaatccttaatagaaaaatgaatgtgacgtgaagtgtgtcctattctgctttttgttctaggaaagagcaaagggaaatatcttaactgcaatattctctcaatgtgaaaaataatttcagtattttcttggagattcgcttcttattttaatccttgaaagcttgcattgtctgttcctataaaggtcaaatataagtgggagtattgggaaatatatacatataatttgtgaaaagtattgtaactgagaagaaaaagtagcataaggcaccaatgttatccagtttggcctataaaattcactccaaaattgtatatcccctttgagggtttgctcattccttatatataggaataaccctatatacacactcagtataactttataggcatggcctcatcattattagtatgtgacattctataattttcaatgaaaattttccttgctagcacctttttctttttttaaaaatacatattattaagataaaaaagctacttaaaacatattctcagttttctgaaagctgaccaacttttatctcaaaagcataatataccttaaatgaaaggatacattatcaaaagaaatacttaagactactcatttcattaaaatatgaaaatctactaatctttacatagaaatatgttcatgtgaatttgtctttattgtatttgaaggcgccaagcagtactttcagtaatcaaagcaattctgaatgaccataactcaccttacttcaaagagataaaaaagcttcttttaaggaagcaaatgaaattataaattaaatttagaattctggacgatgaccctccatataatgacacttctagaagccactttagaagcagacactagacaggccagggctgtctgtttctacattggaagtacaattgtgtaactggtctttattaatgtaagcctgtacctctttgagatgagttcatattttaggaagtcatatttaatcactactatattccccattattaaatgagactgatatttagtttctaaaaaatctttccaatgtgctgcttgtagaatgcaagtcagagaaggttcaaaggaaaactcttaaccctgaagacctgagattctcttaacgatgtctttcactgagcagatcttttgattttaagaaaatccaacttaatcctttttttttctttgatagatcatgcttttggtgttgtgtctaaaaacttactgaagtacccaaagtcagatcaaggacagctaacacctatagtgtatcaaattgttgctcccaacatgaccatctgaaatttctatgctaccactgttgtaagaagtggaaactcaagatccaatccagtgcagattagtggccttatgtttaaagtgtatgcatacttgcaacacaaattcatttctccttaaatctccttacatgtatagccttctccattggtaataacatttacatcatcactaggcttgtcgcataaatatcgaagtacttagaagatctttatgaactttacactcccctaagcaatatttatttttagttttctaaatatttatgaacttagacttaaaataaattgttttaaaataattcacactaaagtcattatttatcaaggattatagtgggaatagaaattatcttaccttcaagaagagaatctagatatattgatttctctacttgtctttttaagcatttttatatgcattgagaagaaacaacaagatcttcaaaatggcaggtgaactaaattgctccagtcagaaaccctgtgcaattgggagagactcaaggaatagcttatgaaattgtccaactgagaagaaaaatagcgtatgatttttatcagagataagcacaaggtcatttctttcagaaatcagaaaatccagaccttccataaaaaatgaaagtcttcagtaatcaggattcaggattcatttctcattttttccctgctgtgctgttacaacctgaagagccagaaaatatcaggcatcttcagtaaaagtattagaagtgaagcagaaaacattatattcatttatggcttttacagcctcaagaaggatatggaactagagacaacctacaacacaactttcaaaattattagcagagagcatctctgtgactacctcatatttgtaatcttaataataattgtggtaggcacatggagtccttaggacatatgctcatgttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaacagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataataaccttttcaggtagattttattatccccattttataaagagtgatattgagctttggagagattaaataatttgtccaaaggcacactgataatgttactgaaacaagatttaaatgacataatgaaactatttgttcaaaaggaagctcgaacagcactctcatcttcaagtttagtgtcagagaagacaaaatatttgtgtgccattgtctttacctctctcttaaaaaacaactggaggagtgaaccatcgcttagattgggcagagacattccagtgacctgtaagaatattcgttctttctagccacacagatgattattaattcatttgaggcatatggctttgcactgtgctctctaaatgctgccgcagtggtggcatgtgaatgattttcttctcctcatcctgctatgaagtgtcactcttccctgccagggagaatagaccatgaggaataactgcttctcaacacggctgtttgtgataaattttaaaccagttgttcagatccaatatccgtgtaatttattgattgattgttctagatggtgctgagtgccaacgctagtcacatgtttagaaaaaaatcaacaaaaactggctcagaaaagagactgattttctcaacatcaagaagctctcctttgcattcagactcttgttcaaaaatcattaggctccttttgttttccagacaacccaggagaatgatgtacacagatgaaagacgtagccacctgttctcaagcatttgcaatctagcagaacagaaagttgtaccaagaatcatagcaagtgtattaagtaccataacctttatggggagctacaggaactcaaaagaggaccaataaaagccaggagagatgagaggttttggcttcctgttggaactaactatggctaggtcaccaaaggatcatgcaaattttgataggacaagaaaagtagaatgatgattctaggaaaaccgaaagcatatgcggaggctcaggggcatgaaagcacagcttgtttggggaagtggaaagtagttaagtttggcaacacatggtacatttggaaaaatgacaggagatgcacagaaaataattttaaatgaagaacctgatgtttggctcagtattatggaggcaaatatctttgttttgaattaaaatggagattctgtttctgatttttttcaagtaattttttttcaatgttctcaaattttctttgacttataaagcagtacaatgtaaaacaatttcatatttcttgtagtttctgaggaagacaaaggatttggaccaatttttgaagagcagccaatcaataccatttatccagaggaatcactggaaggaaaagtctcactcaactgtagggcacgagccagccctttcccggtttacaagtaatgtacctcgcttctcttttcagagtggagtgtcagagtaatgatcacagatcagcatctatgaacttgtacagatgtaatatagtgctttctgcaaattccatggacattaacaaaaatattggcatacaaactattaaaaaagttgcctaatgctcaaatagcagattttcttaaatatatgcaaataattctcttactattttttgcacagataatgttactggcatttgacattatccacttataaattgtataatggaaatcatgtttttaggcccatgaatggttacataaaattatgcataatttaaatatacagatttgaggataaaatgtttttgttatgtactggcctgcataactcatacctacagatatggataaatttttatattaagtacatttaaagatcttgcacaaataactgtagaaagcaccatatttttcaacagtctcatatctatattccacccaacacagcaaatttcttaaatgtctctacctataggaaaatctatataaacatacctcttactatttttctgggttacatatgtatgctatctaaaacaactttataaaaagcaacaatgagttttcctgcttcagatgggtcataaaagtatactaacagtttctcatctgatgcaaagaatgagatgcaaaaatcaaccaaatgccagtggatttaaatttcacctgtgcaatggttccatgaagacaaaacaagtgactgatggagaaattgggggctctagtgtgttaatgtcacctgacttaattgaaagttgtcactcaacaaagttaattttaatattttttccttgatacaaaagtaactttctattattataaaaagttcttacaaaagagaatatccctttccacccatttgattctaacagtactcagttttttcctgcctttggctataatcacaaaattattcttaagataaaattgtgaatttagatacaaaatcaccatcccattgaaattatttttatcgtttcaatttcatacatggaaatatgatataagtaggtattttataaattataaataacacatttgttctcaaaatatttgatgggctagacttatttccacccttaagccatatataatgagagcctatttgtcattgacatggaatagtagaactaataggatctgtagaggagatccaatccaagaaaattttacaggagaggaagctgaatcctgaataagtaaatttgcttgctcaagaactagtaaatcacagatccaagactgaaacacagtttttatgacttccaatgaggtatgcaattttttcattatttatctatctggatagattgatagaatcccaaaaactctttcagtgacacttatgctgtgacactctgttgttaacagtcacacaagggaccttagcaaatcagtctctaggctagaacagaggcaaccaaaagaaagggctgctctcagataacattctagaaacatggaaaaggctatgcttctccttgctgcccccatgcccccaccccacaggcacaataaaaagcaaagctttgctttgccagtaagtcaccaactgcctctctcaggttgcacccagcactgaaattcccactttgagtttggcctggttatccatacactaatagacagaactggagaagacagatagatgtttaatcttgttatgaagacagtctgcatttgacaggaaaaaaaaaagtggggggaaagaacagaaaaaaaatcagctcatgatggaaatagtttgatggaaaagaacatttaaagtttttaaaatgtacataatttcaggacaaattatactaaccttggtaatcatccaatttttcattcatatagtagttatatatttgtagcatgttctgggacaacgtgctattcatagcaacatcctgagaggtacaacagggtactttacttctgacttataagccttgaggctttcattatcttgcccccatccccaaagaaacaagcattacaataaaaaagtattaaaagggattgtagcaatagtctatgtttctgaaactagaccagtgaacttcttcaaagacagaaaaaggtaatccttatatgatgtcacaagcacaatcagatccatgtggaggaaggtaagataataaacaaatatttggaaccaatataatgagggagaaattacaaaaattggagctgcccaacaaagaaacccactgtcttgacaagagctaagcaacttaacactagatggttcaggcagggacaatattgccatcacctgggggaagaggaaggctttattcattggattgtaatttagtaagttttaaaaatgcaaaatcacagttttctatacttgcttttaaattatctcctatactgcgaaaattgtaactaataatgttccagtaactttgatttgacaacagatattctaaagtcattaggacttttgggcatgattattactctaattagaagtggccaggaaatgagcgatgtggccacgagccactactacttgagcgatttgaccacagctctaggcttatgactttcctgaggacatggaactttaaaggataaaccctgataaagaatgattataaaattatacagttggttctcttagttgagaactattttctacatgcattcttttcatcatcacatcagaaagttagatccctgtttccagtctatttataacactatccctatcagttaatgctctgattatctgcagcatgtcttatattgttatgatattatgtggttggggagaaaaagaattgttcctctttttcactttattaaaagtaatcttagagtaatgagaaaagacataagtgaccactaactctaggctgaggaaaatccagatttacttgtatatttgtggctcggaataaatttttaaaaacccaactgacttttatcattttcaaattgtgtgactgacctctagtggtcagaatatgtcacttattgagcagaacccactgtcaattagtttgttttattgaaaaattactttgaaatttagagtcagatattgatattttgtattttatttatggtagaacaatgcttttaatactttatacagtatatctgcatatgtatgaatctaactggtgcatagatggctatcaattacatcccaagaaatcaatttatggagaaaaactcaacaaaatatttgtcacttgagatacctcacaaaaaaaagacaaaatacgtcatgtactttgatgtttccttgtctgtacttgagctaaattacaaattatggtcctagagactcagaatcatagagtacaaagaaataccacctgaatcatattcttaattgtctgacttcacatggagccgtacccaaattattttagaactgtgttagctccgtagagtttctaggtctcatgacctgtgatatgacctttgtgtctttttctcatagatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatgtaagtaaactgtaacttttaaaaaagggcaagcgtgtttaggtgagttcagcaagaagaacaatcaggaaaggatagtgagaggaaggcatcatagatgaggtggatcttacaagatgagtggaccctaattgtgtaatggagacaacaaagcaccacaaggcatactatgaatgcacttgaaacagtgaaagatgatgttgtcaaataaaggaaggccagcgtctgaggatcttgaatgactctttaaaagttagcatcaggctgggcgcggtggctcacacctgtaatcccagcactttgggaggctgaggctggtggatcatgaggtcaggagatcgagaccatcctggccaacatggtgaaaccctgtctctacttaaaatacaaaaattagctgggcgttgtggtgcatgcctgtaatcccagctactcgggaggctgaggcaggagaattgatggaacctgggaggcggaggttgcagtaagccgagattgtgccactgcattccagcctgatgacagagcaagactctgccttaaaaaaaaaaaaaaaaaaaagacatcaatggaagcaacaagccatgtattatcaaaggggcactatcacccctaagggggtgaaaattgtcttttgggggaagaaaatgtcacatattgcaacataatgtctgtgactcttcaaagatcaacccaatatgacaatattgtattccctaatatttaacttctaatagtaggaataaatttaattatattttagttaatttattttaaatttaaattacatgaaacatttcttttaattagggctaataatgaaaaactgtgctaagctaaaaattagaggttgttttgaaagaaaattttacattgggagatgagttggaccaggtgatctccagtatgtgatttgtcagcacttaaatcttttgcaaaatgaattataggatgaaaacaatgttttaagaagtccttcatggtagggtttatcaggagggaatgagaaaggtccaggaagagaagtaagattaaattagtgtggtgagagtggaaatgtaaataatatacattaaccataaggaaagaattaacaggttgcattgcacaaaaggaaagaagactgtacattttttttccaagttatgtctagtcagagggtagaaacattctgttctcattaataatgggatgggagcaagaaaaaccaatttcaaggatggcaggaagcatttaaatggttgcttcacatgcagaggttattttgatattgagttatccaagttgaaatgtcaagtaagctattgaggatagggatggcattcaagtaagacaccaggcctagagaagtagatttgaaaagtcctctgcaaaaaagtaacacttagcatagatgaattttcagaggtatacactttatactgagaaaagtaacaattcaatgttataatttgggtgccgatcacaggttaggaacaggaagagaggcagaaaaaaatagaatgagtatcagtaaaacaaatgaagaactggaagaatatcaaggaatcaagtgaaatgtaagttccaaatacatagaaaagagtaaagaaaattagaactgaaacaaacccagaatttgagaaggagcaagagattggttactttcacgttccctaatgagggtcctgcctttcacccttattccttcccgatatccaagccctccctcaggaagagaaatacccttcaaatgagtccattcctctaagtcattccttcttacttactttctttggtaggtccctggtttgtctgatttcattgtatttccagataccctgactgagattctccctaagtctgaaacaaaagtcttcaggatatttgtgattttcagggttgtcagaattcttatgcaggctgctcccaatatccatagactttgagctcataacagaactttttaatagtctatacaaaatctcagcaatgtaagaacgaggagctgactttactaggcttcaccaaaccactgagaagtgctgtatctcacgaatgagttatttgctgaaaggtaaaattgatgaatgtctctctttctattgaccagagagtgaatgtttctctttttttctttcgtaattagatcttgatcctttcccacctgaggaacgtcctgaggtcagagtaaaagaagggaaaggaatggtgcttctctgtgaccccccataccattttccaggtaaacttaattcctctctgactattagcatctatgaaacaaaatggacaagtttccattttcttagtaataatgctacattattaataatcatggcttattattaattaaatgagactgaatatttgcataccttgtaatgtgtcactaattgttgtggacactttctttcttggctcagtcacctggctctagtcccaaggatctctaatcattttagtttataaacatatatatatatatatagtattatgtcatcattaaagttcctattccatagggaaattctgttagattttctagaaaatattcctgaaatagaacagtaccaagaaaggatgtataatcaatcattttcttaacaagttagtatctatgaaatactgtgaactgtatgtaactaaaccctagaagggataaagacataataaattattaatctccttaggaataccaatcagcaagaataatcatctactttataaatggggctaaattaagtgtcatctgttatgaaattcaattttgaatctatgttttctgtaattttatatggctaagacaaaagccaccaaagtgctaattaaaagatgaattcctcatatactttcaccaattttcatttatttatcaaatatctctttgaaacaatatataaatacctgttttcacaatttaaaaatcatgtttctattcttttagttctaatattatgccttaaatttgactttaaacatctccatagagaatgaaacgtaacaggcttttaaactccatacaggattttgtgtgggatacatcaatctgatgtgtgtgtatgtacatatacacacacatatatttcacacaaaattatgttatatattccacatgaaattgtgtgtgtgtgtgtgtgtatatatatacacgtatatatacgtatatacgtatatatacatgtatatatatatatacgtgtatatatatatatacacatatatatatatagagagagagagttgtggttgtttacatatcaaatatttgtgattttctccacaataggagaaagatgattgcttgataaatacaggaggtacatataaaattcaaaattttctaacaccctttcaatgagaaaaacctttttcttaaggaactattgaaattatatatatatatatatatatatatatatgtatgtgtgtgtgtgtatatatatatatatatatatatgtatatatacatattttaaaaacctaccattttcatagtgtttcccacaaagtaatgaccaaaactatccagtgactacatttgaccatattcaatactggatggacttcactgcatcactcattgactcagaaaatctcttatgagtatttgttatacagcaggcacaatgtatgccacagaaatgcctcagtggagcaaaacaggaaaagctaccagccttcagaggtcttccacggggagagtcagacattaataagataaatggctaaaagacatgccatgttagatattgctaaataaggatagatagatagatagatagatagatagatagatagatagatagatagatataatgcagggaagtggggagagtaagtattgaggggaatgactgaactcaggaggagcatcactagaaggaaagttggaataaacacctgaaggaagtaaaggagctaacaatatgagtatccgagagaagagcatgccaggaagatgctgaggtcagactatggaagaccaaggaagccagggtggctgtcatagagtgaataaggcagagggtagtaagaaatgaaataagagaggtacaagagctgcattatggaggaccttatgatccataacaattattaatactttggcttttactttgaatgcgatttacattggtgggctttgagcagaggagacacatgacatgacttaagttatagaaaggtgactctggttactgttttaagaaaggacctggggaggacaaaggtggaaacaagagatctgtttggaggtattgcaatagtttaggtagcatatgatgggccagagtggtggcagtggaggtgggaagataaatccaagcatattctagataaaatagaatatactaaattctatatagaaatctaggtatactttggttaaattctagatatattttgaaggaaaagccaataggatttgcttgttgactttatgtggtatataagataaatacaagagttgagggtggcataaaagtttttgctgtgagatcctaaaagaatgaagttgccattacttcagctgaaggaatagatgtggacatgttaaatgtgaagcatctgttaagcttccaaacggaaatcaaggtggcagttctatatgtgtgtagatgtcgggggtgatggaatatcaatttatgattcatcattcaataagttgttttcaaaactatgggactgcaatgtgcttacctagacttctggggcaaaagcaagaagtgtcatatatctaccgataaaagcaacatttcttaagtatgtgctggcacttactgaaaaaataattttatggttatttattgtttaatccagtctataatccgaggaaaacagatagcttttgcaaagatgattgattttatcatctgtgtggggctaggaaagacacaaagaagatggtctgttgagtccttgaaagaactagatcagggcttagctcttgattgacaaagtcacatctcatccgtaagtcggagagtcagcgtggctattgctctggtgttggtacagcttattttggtgatggtgggtggggaaagaggtgagaacatcagttctgcctcccgtttgctgtatgacctcaggcaagtcacttcaccctattaggccttggatcccccatttaaaaatggcaagagccattcctacctttgttgtaacgattgctgacagattctaacaaattgcaattattgttttgtccaagtgaatggctttaaaaataagtaagatttgttaaataaatttagattaattatattgcaagtcccacaaatccaaaggccacatctatcttgtttagcagcacttggaaggtacttagattttgcaaaataagtaaattagagaatctacatcgggcattcagtcagttagaccagttgttctatagtccaagacttatgttcatacaacatcacgacaataacttctcggatttagcatttatcccttataaggatcaagtaccatcacttctttcattccttttcacacatctcttatgagtggggcacaggaaaatgtcttacattttagagaaactgagtaatagagtgactaactggcctgataaaaaagtcatactgagaattaaaattcaggtctctgtattcacataaccactgaggattcagattactctaaatgcattttgtgggcagtatctttcatacattctatagttacaaaagtcctttctctgtaaggaaatacaaaatttcttgacatttttggctttggtggtggggcagggggagtggggatttaatttttaacagaaatccttacaaaatttggatttacatttcaactgagaataggaaatattaattcagaatcagaaaagatcaaagtcttcttttaaatgtactatacatatcagcttggatgaaagactacttaatactcctttctgaatgtgatacttctttacttatcccaggagccctcatttaagaaatttaagcagctccctaaatattttcctatactaattatcctgtgaccctaaatcagcaagaagaaaacaaatgaaaagaattcaattattcacagatataagtgcctagaaatatatgttaaccgtaattctgagttagaggctaattatggtagtctaattttctgcctctttttatctgtattctgtttcttcaataataaacatatgctgctgcttctataatttgaaaaaatcaatgttgaaaaccaaaagaatataatcatattcactgcctgtcttgatgttgtattttgctggagaaaattacatagctaagctaaatataatgcccaggttattattcccaattatgtgaagcttatataatgtgcatctcttttagtttttcatagtcattgtgctttcacactctctttgaaagctttgctagccacgctgagttcccgaaagcaaaatagccatttgtcatgattattcatctttaaaagaagcctgagtgctgtgatttcttggtttttcaccattttacacctaaaatcctatctagtctgacctagagagattcccacttatattcttcccagtagaaattgtctttatgtgatcaagatgttttgaagggaatcatcattttttgacctaaaggtatgcattgcccattgtctccttgtgtatttgttgaatgactcctggggagtcattcatcaaaacagagaggaaagaaggaatagaaaactataggaaatgcagcaaattaaggaggaaattcagttttccatttaactagttagtgtgttcagccaaaggaatttcatgtgggtaagagttaccatatgatacatctcctaatatttaattaaaccagtaccatacttttccctgtttctgtggtttccctttttaatgtgaccacaataggttatgtaagctcatttctaactctataaaataggtgcacacacacacacacacaaaaaaaaaaagataaagcaataatatggtaagtaatcttaattatatttataaaatgcagtttggcagattaatcatggctttcgagttattagacatggattcaaaatcctatttcttcttaatagtcatgacattctaagcaagttatgtaacctcttcgagtttcacttagcccatcaatgaaatgaaagcaagaatataatagtttattaaataatagaaatagataaatagatgtaattgcttagtgtaatgcttatattcatgtgaaatatggtacatgtttaaaagtgtgcactgtttgtcttggctttctcctaacatttgctccacaatagcctttattagattaagtgatagcttgttactagcctctattaaattatgtaacaactttgggagaagcacttaatatttagaaggcaatattttctcctagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgtaagtattttatttgttacactctgttttcgcaaggttatctacatatggtatacttaccgtaatgaaaagaaatatccagtgaagactagctgacttttcaggaaggacaatataaaaggggatgcatgttgaaggggccaaaggcttggtcctaagctttttgcgttgagaagatttagctaataaaattgctgtaagaaggttgagttcggatgagttgcctctagctcggaaaatacacaggggactgataccttagtccagttctagtgtattggttacagtggaaatcactgacatctactttttgttttgtggccattcctacttcttagtaagctcatgaagaaatcaaaggattggtagatcaaaacaaacaatagtaattgtagaattttttaagtcattttgattattttggtatttttaaggaactatttacatgatacaaataagtaaataaatggtcttttctaatctacataatcagcatgaggtgctaccctggtagcaccatggcagatgacactgacaatctgattggcctttccccaggctccaattgaactacttcccttttaaaaagcactgctgcttaagagaatcaaatcacagtatacttgcttactttacattatttctatccaagtccttctgctacattaatatcagcaaattcaagctcatgagagcataccagcttcagattaacagatttaggtttggctcctgcctttacccctaagcacagtgtgatgatgggaaaaatgctataataccattgaggttccatttttatttttctctgcaaggcaacactcacataattggtattcaaaaaatattgttgactttctggctcatttttcttttctcagttttaagagataatctcaccccctacttcatagactgaaaaggagccatcatgtaaaaattctcttgattttctttctactcttccccagaaatatacttgcaattcagcacttctatttattttcttactttttgtctccatagcagaaatatttctcccctcgctcaagctaagttctccagttgttccggttcacattccatttgtttcaattagaaacttcactacaacacttattttcttctttcctgaatcctcagattctgctctacctcattatctctgcatattctcttgtattcaatgcaattttgaattattatgaattcctatttgctaaatccaaaggacactttgaagtccttattctgtttgaactttgacactgcctcttctgcctttcatgaacttttctttcttcacttaatttcctgaactcttcatctcccttctgcctctctgacaaatttcatagaatattcttcacaaaatattcttctttcttatatttttctctaatcttttcctaggtattctcacccacttacacattttcaacagtatacctttgcaagagacttcaagttcacatctccgaaacttttcttgtgtttagatgtcaattcttcctatatcctggacttgtcccccagaaagctctcacagatgttaagctcaaagtgtcacaaatacatgtgttacttctctccaaaaccttccttttatttagcttatttagcaatacagtttcatttctaataactcaaggtagcattatttattatcaaatcccaatttccactgatcttcaggacagctaaccctgtggttcttaattagtaggtaagcacctggggagttttgggaataatgcaggacccagagatactgattcagcaggcctggaatatgacccaggaatccacaagttgaaccagtatcctaggtgattctgatgattgagcctttaatctacaccttgagaaacattgatccaaggagccgtcctgttgattctgcctctaaaatacaatttatatttactgtttcctttctgttttcactgtaactatgccctagtgttggccctcacctgttttgcctgaagtattgaaacagcctttttggacctctgagactgtcttctatatttctcctctccatgctccatcctttaaaaatgccagcaaggtcttccacttaaaccaaagataagatccatattacttctcttaccaagtcccaatggtagttacctgatacgatttggctgtgtcctcacccaaatctcaccttgaattgtaataatcttcacttgtcaagggtggggccaggtggagataattgaatcatggggggctgtctcccccatactgttcttgtggtagtgaataagtctcatgagatctgatggttgtataaaggggagttcccctgcacatgctgtctcttgcccactgccatgtaagatttccctttgctcttccttaatcttccaccatgattatgaggcctacccagttatgcagaactgtgagtcaattaaacctctttcctttataaattacctagtttcagatatgtctctattagcaccatgagaacagactaatatattacctattgagaaaattcatctcaaaatattattttttcagtccttctagattgtgggttcaagctcatatacttcagcatcatttgagttcctagaccttttaaaattccttgcacactcctggagctttgtcgtaatatggtgtttgctcaagctaaactggtccaatttaaatgccatatttgcctcagagtgctatagcccttacctacttctaactaccgtcctcatcagtcactctttcaaagtacccattttgatttggcttatatatcattatttatttatttgtctctttagcattttacagtgtgtggtacacactcaatttgtgatcctaaacaatgcctttcacctttctaagcctgattttttctgtaagcctgaaggattaatacatctttcaggactgatgtgctaaataaatgaaataaagtgtctagtttgaagagtgctgtgttgtctgagtaaatgttttccttctttccctctctccttctctcttttcaatttgtttccctttgcctttatctctgtgggcatttcttcttttctccttagtttcttgccttgcgtctttcttttctactctcttctccttcttctctttccttctccctcattttctttctccaccttcctgagttccatgcagcactgatcacaatgtttgacacatatctgttgctcactaaagacaggattttttttagtaaattgagtcacaatggttatgcagctgtcagaacgagccaatattattgaaaatactgagaagttatactatattcatactgtgcataaacaaacaagtctatccattatgatatgacctgtacctgtacagagaaaagcttccatgttggagcagctctaatcctgtagaattaccatgtttaagaataactaatattgtgcctaataattagtggatatttgtgtttctcttaatattaggaacaacaaaaccatatcctgctgatattgtagttcagttcaaggatgtatatgcattgatgggccaaaatgtgaccttagaatgttttgcacttggaaagtaagtatactgacacttttattaatatatatagaaatagtaccattttaggaaataaataattgtttagctataaacataaagtaattgtcttttaagtgtgtgaaactttaacccttgtatcttctatttaaagtcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaaggtagatacattattttaattttgtataaatttcatcagtatcttatttagagccatttccatacatgaaaaactactatataatgattaatggttttaaaaacagtgatgcatgttacatcatggagaaagataaaatatttctcatatgtctaatgaagtcacaactatgagttatagaagttacgaacttattaccagttgaaccataggtaatagcaatagattgatagaagtgttattggtaattttcagaatatacacttaatgtagtttgtttactcattttatcactgtcttttttcagtatctttttatttatagaagaagctatgtgttatgacttagtttaagtcagtggtttgcaaacttaagcatgcatcaaaatcacatggagggcttgttaaaacagattgctgggccaaactctcagaatttttcattcagaggtctgttaggggctcatgaatttgtatttttaacaaattcccaaaggatgctgataatattggtcctggagtcacactttgagaaccactggtttaagaaatctttttttttttttttgacaaaattatcatggcacaaacctttgattttcacacattaaaataaacttacatttgggaagacagattttttttcaggccacactggaaactttccagactgaaataatttctataatgttccacaacatgaactttgcaggtcacaagtgaataaacatcgagggcttccacaatattattcgtttttaactctggctactgtcccatttcactttctcccgtctctcccaaaaaggaataaaaaatttgacagattcacgcattctctctaaaagtgttgtctccatctccagtttttcttctctcttaattgcactccaacatgatttgcatctctgcctctccacagaaacctttcttttcatgaccacagacttccatattgctaaagctaatgatcaattctcagttgtacttttttttgatctaacagcagtggttgccacagttggtccctcccttcttcatgattcactttctgcacttcatgtctgcaacctactttgttattaatttccttgtataatctttcattctccattgcctttcaactccatacttttctaacattggtgtgatcagggttccatctgtgaaccccatctccatttcagtcactccatttatgatcccactcgtgatcatggctttagacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaaggtgacagagcacatatttacagaaggtaatttaagagaaatattatttattctttactaatgcagcatactaagtattatctttaggtctgatcacatcactagaaggttacataattaagccatatatagactgtgtcaagccaattcaattattcattacatgatgtaatagaaaatgtctgtgttgtctttgtgaggccaagacaggaagggtgctgatattcctgtattatgtattgctaagattgtatacaaaataaaacctttctcccttacaatgaacatatccaccaatagtttaaaaaatatctccctatgttacaaatataatgatgagtgaaaacatgtactaaataagattatatatgctttaagatatataggtgtacatatgtctacatgtataatgtatacattataatgtataatgttgatggtatttggtgagataaaaatgttttctagtttttaaatttctagtattttattacttgttaaatgttttttataagatgcatatattgcttttgccataaaattaacacaagttcccagtttcaaagaaaattaaatattattctccactcaggattctttcttcctacttcctttttgtattaatttatttatctgcatttatttggactagataactgaaataatcaaaaagactgtcaaattgtttatttgcttgttctctaaaaatattttttctttggaaaatttttagcattttctcatttttatggatgtctctttagctatcaagtagatcagactaaagaatgagactgagatcaattttaccaatgcatggatttcaccaatcatggctactgtatatagtttctaatatggaaagagtatatttaggtgtccaagtcatttttctagcgccaaagtgagatgttaccgtggccactagctgaaagttccatcaaaatgaagataatgtatacctgagggagtgggaaaaatatctgagtctttatccaaaatgttaagagatggtatcatattgaattgagatgtaattctttaaaacctcaattatcattttgacagacttgaaaggtttatgttatgagcagaaaaaaatcagttattttagtaataattataactcagcttttcaacaaaacatgatttacaaatggaaaaataatggctgagttatagttacctcctgctgtaataatacaggatttgcgtaggttaagcctatgcaaagacaaggcctattactgagttcaggatgcatacactatctgatgtattctgcagaattaggttaactaaatgtaatatttatactctggagattatgatggatcttgagcccttcatttaacatttacaatgttccttactttttagcattccctgagtgggtagaacacatcaatgacacagaggtggacataggcagtgatctctactggccttgtgtggccacaggaaagcccatccctacaatccgatggttgaaaaatggatatgcggtatgtatgttcaagtgctttgctgttcctgagtccctgttcaagcagtgtttcagggtagtcctgggataaatttagcaggagagacaatacagaaagggcacttgggccctgaaatataaaagcttcctaaaaaagacaaaaactgaacataaagtatcttctttcagtttaaacaactttctgtaatcttactctaccttctctctctctctctccttatttttttcctttgttccacttttccaccctcttcctactcatccatctccaatacctgatattgtcctctttttcttgccactattttcctgtaccccacagagacagaggtaagagtgaagctctaagtcctacctttggccctggggacaagtagcagcagtgggattcttctctaccttcccactgtaatctcccagctggtccaagaggggaaaaggtggactctcagctctgtaggatgaatagaacaagagcctttgggcatggtaagtgggttttcctttcccatgccatgaaaatcccactcagttcatcttaggtaacagtgggggcagatgaacataatgtatctaaatgaaaagacaaccaaacccagacctaagtgaaagtatttctattaaagttcattgagaatatgtttcaattttattcttttcagtatcataaaggggaattaagactgtatgatgtgacttttgaaaatgccggaatgtatcagtgcatagctgaaaacacatatggagccatttatgcaaatgctgagttgaagatcttgggtcagtatcatttctaatttctgttaaacattgttaaagcaatatgtcatatcacacaaaatgtttattgagcctacacaaaatacccagtattgtgttaggtgtacaacatatgttggttgtttactgatttatttattgctaattatcataattcagactaacgaaacaatggaatagaatgaatctttgccacaacaaaagtcttcttcagagcatcagcagcagtggccatacctaggagcacattagaagtgcagaatcccaggctcaccccagacctactgaatggacactttaaaaagatacccagatgattttaatacaaagataattttgagaatgaccagaccagaggatgaagagtcaaaacccagatgaagatatgcttaggcctagaaaagcctccagaaagtacatagttacggatgattgtaatgtgttgaaatatatggatgaaatctgcttggagtctgccaagggaagaggagagtgagcagtggattaaatgtgtggatgctgaggaaagtctgagcatgacatcaatgaagtaaccttttttaagcctctgtattctgttctaataattattgctctgtacttggaggtaatgatgaactacaaatgatcatgtctccttaattagttgattagatccattattcccatagctgtttatagatagatcctgaaagcaggactccaattattttggcattttgcagggtgtttgcatacagatgatgctcagtaattgtataaagaaggagagactgcattgtttaatgaaaagtacatgctttggaaacagaaggacctagattcaaatgtgactcccacttattactacctgtggtacctttgccaaattaaataatcctaatagatttcaattttctcatttataaactgggaatagttcattcaacatgtggtttagaggattgactaggaccatatgtcagtgtgtataatgctggtcaattttttccagcctttcactttactttccttgtggaattgagtcaaagcaacagaattcagagttaattttaaggtaaatgtgtataaaacatttgattgaaattgaagttatttatttattgagacagggtctcacggtgttgcccagcctggagtgcagtgaggcgatcacgcttcactgcagccttgaccttctaggttcaggtgatcctccacctcagcctcctggatagctgggactacaggcatgcaccaacatgcccagctaatttttttgtattttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaactattaaggagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcaggtcagtgctgaaactagaaatccaattgcaaaatctgtttgaaaaagtttattttatagaagacttgtttatatgttaataatgaaaatgttttttgctctgaattttttttttcacagaagatcctgtagttctaagatggacagaaatacctatccctgtcagtatctattataatgaaggtttaattaacaggactctataatgtataaggaatttagaaaattgaagctcagaggtgtttttttgttgtcttgttgttataaattgcccaatgtcacacagctaataaacaatgggaaataaagtaggatctctctaacatatttttccccagtataggcatctggcatctatatccattcatattcaactgaattttgtgcagttagcctattaaatatttttgtagaaaaataaaaaggtgatttcaaagtgcaaataatctcttcctatctcaaaatgaacaagatgttatcatcatcttccttataaatggaccatctaccaatgttttggtggtttggggacaaaatgaaaaagcagtgtacaacttatatagattatttgtataaaagccacactgaatagtttatatgtatcctagaagaagtaatattgagtgcaaaaattatgacgaggagaaagccaggatgggaaatgggagggatgggatgtgtgggttggcttgagggtgtatgtgagggtgtatgtgagggtgtatgtgaatgtgagggcagcatgtacaaaggccctatggtgaggagtttagaatgtgtaagaaattgcagaaactgaaatcagtgtgatttgtctttagaggaaaatggaggagacttttaagagatgagacatagtaagccacatcataaatgacaaagttttctatgctaaggggcttgggcttcatctaagagtaatataaatctgtttaaagtcttaaacaagggaggacaaggatcacttttgtcatttgaaagactgttattactcagatgtagaaaatacattattttcttcacagtaacccaataaagtaacatgggaattatcatccatattttgatgtgtctaaagcttggtaaagttaaagtgaccttctgcaaaaatatattcatgctatctaaactagaacttgaagttgtaagacattgatataaattgagaatatgccagcacagccctcttattaggatgagcacaggcacggctgtttatggaatggggcaagagggcagggacatcaggggcttccctgaacacactgacttttaaagttaatatgtttgacctcagggttgttaagattttaacaaaatgatactacaagaagggttaaaggaaaagtccatttgttcaatttgccgctgaaacattaatggtcagacaatgagcaatgcagagaccatgatcaaagggcagctacatgtgtaggtgcttactccttccacagcctagagcagggcattccccaatggacaaaccattagttctcttccgtgataataaaatctttttctgattctgatgaagacccatgtcatggacctcttcaaccaaggatttcccagaactatgtttcatggacttgtttttcctaaatatcaatatgtgttcaaaaaaagaagagaaagatctagctcctgaaattttacaagtttgattgtgttctgatatttttaaagcctttgaaatcaaattgcattatttccttgattaaagagtctataaatctaatttttacttagtactttaacccattactatctcagtgtaaatactatttaatagtagatatagtattcatatgcaaatatatttgaattgtaaaataagatgtataaaaagctaaacataaaaattttggtgtctattttgaaaaagaatacacaaggactaactaaatattggtctttaagcataaatataatcttattcttctgaatataattataaacaacatttccacgtaactaagttatttctgtatctggttagtgcctaaagagtggtttatatgatatttggaagaagctatgtatcttgataaatagtaattaggttttcattttatgattttatttttggctcaaatgatatattttctgcagcagaatttctttgtaattagcagaattaagttagttgctaatttaaattcaatggattgctattagctctaaggtcacttttatttaaaccacttataggaagggatcttcattagtcttttctactccagaggttattctggagtaattttggtaccaataagtgaccaattggttaaagaccagattgttcctagtttgtttgacagctgatctatatcatagtatctggaaataaggataagatcttgagagtttagtctatattactttaagaataaagagaattattacaaaaaaatcaggttttctaaatatttttattaaaaagtaattttaatctcaaaggcaaagtacctgaaagtataaatgagacgaatgacacatggaattatgtataccctttaaagatggtaaaagatcaattgaaaactaacataagtaagctaaaaatattagcatgatttaagaaagaatcatcattgttttttccactgctacttcattataatttttgttgtgcttcttgaaaaataattaaatgaaagggatgtgggaacttggctgaggatttatactagagggtagtgagaaaaagtgtgacccattaatattggtactgtgttaatatgtgtcctccaagaagctgaagccaggaagattagctatgtaagaaattaattaatggcaatgcatgggagggaaaatagagaggaagctggtggaggcttggaaaagtattttactgagatacaggtctgatcccagatgaaggacagagggaaggaaggaaaaaagattgtgttgaaatgacttggactgcactgcacttctaagagtatggtcatgccactggaaagtcttccattcaaaaatgcatatcagaggagtttgctgtcttccaggagcaggcctggtttaaaattcctcccatggtcagtcattggctaagaacagcctgtggaatgtgtggctttgaataaacacagtgatggatttctgagtacggcgtctgggacagagaataaattacactcctcagagttggagagtggcatattctcagagcttccatgatcttaaataattacttttatcattatattattttgatacttcatttctccttcaacaacaaaaagtactctgaaatgagcttcaagtcaggactggattgttcaagaaaggaaaggaaatcctggactataatgttagcggaaattttgttattttcttatatgaagatttttatcagtaaggtagatagttttgcttcttttatcagactttgcccttaaaatggatatacgtttgcatgttttgtgcaaactttcaaagataatttagttttgaaaattatctatttaaagaaagtaaaaaatccaatgacaggcaattcaatatttaatctaagtgtgagtttctatacaataaaacttagtgagtttttagtgtccatcccctgaggaagaggctgacaggtagggaaatatgtgtagtatgaaagacttagtttctgttcaaagaagaatttcctaaatattaatttgttccagaagttgttactaaggaggttttaaaatattttttaaagtttctaaaaataaaatacatttatatttctctgtagccatggaaatggcaatctgtcctcacctcctagtctgaattgaagtcctgaggttacatttctgggagaccggggctcatttctttcaggcctatgactgatttcagcctgtcccatagtggaaggtcagttagaagactacggcaatagttcaagaaaaagatgaaagtggatttccaaaacaaaatgtcaatgatgagaaaaaatattataactaaaggctagaatttgtcatcttacaaaaatgtctgtggtcgcatgatttatatagaatgtaataattgaaaaatattagtgtttgtaatctaagacataataatgtattttactaaatcaggtttgtgaattatatatatttttatttcactagaatactcatttgggaagatggtagcttggaaatcaacaacattacaaggaatgatggaggtatctatacatgctttgcagaaaataacagagggaaagctaatagcactggaacccttgttatcacaggtaagttaatgtttgagggtgcttaatttctaatgtattaaaaaacatgattcagcactaagcatctaaacagtcaatgtatttgtaagtttctttttcaaaagaatttcaggcaagtttcttgcttgatgatattgttcttggaatttggaagtgaaaacatcttattattttgcacaaataaaaatatattggttattattttaatataccagataatattgtgtcttatatcttcttgaattgtgctttacatttaaaaatatatagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatggtatgtgttttaagtttcatcttattaacaccccagtgattcctatgtgtctgcattgaaagttctattactataatcacattttatatcatctttgtttttcatgagaccaaaaagcaggcaaaaaagctttctgtggttctccttatattaactgttgtactgctaaatctttctaaaatggctagccctgaggattttggtataaatattaatcaattaatattaattgggctttaggtatgatttcccccttaattttaatacaattgatgtgtattacatcagtatatatgtgcccttggttctagtgccttcctttttactttaaatgaagagcatagaacttaatctttgttataatgatgatcttaaagcatttatgttatgctttaagagtaagaaagagacaaaattatatatgttggagaatttggagaattagtttatgtgatttgaagagggttaaatggctatattttaagaattgaaaggtgttacattctacaagtcctatagttaaacatagtgatatagagagtcaaggtgtagaaagaaataaaatagagggaaaagactgagaagtaatgcaggcaaaacaacttgtgtaagaacattgttggtgtcttggtaggctgtctaggttacagtgtatttaaaaagtaaattaatcactggccctatcagcctcttctttagaaaagcaaacatttgtaagactaaggacatatttagaacataggcataattaggaaaacttttattttagaagtcagttattaatataaaaaagaagcacaaatgaactcagtaggacatttaggattgtttaagtcccataaaatctgaagattgatatgtacacattattatattatgctttcatattgtccagctatgtttttagctttagaagagttgtaatttaactgatctagctacaactgtacacctctagtaaacataccaatactctttcagtttctgaaccaaaattatactttaaagaataacaattgagaattggcagagaactgtaaattttgtattttgacattatataccatgtaatatattttccttatagatctgaaactattttgcacatgcccaaaattagtcaaattggcaccaaaatctccaatactttatttaaagtgtattttattttgcaagaaaagtaaatacaacttgggttttattcattttaaaggaaaaaagtaagctaaacagggatcttactttctcaaaaagtaggcttctgaatttgaaagaattatctttggtgttataaattgaataatttcaaaagtaaagtctagaagttccacaaccatagtttataaagtagtaactaatagctgcaatgaagtctatgtaaataaatttgcagacaaaaattgccctaaactgaaacttcatatttagagcttatttatattctttaaaatactaattacattgtgctggtacatgtaaataatgactgcaaaaagaaaatggaaaaaaaaaggaatttaaagagaaagaaaaatagatcccagtcccctttaaaaaaaaaaacaggaaaacaaagaaataactggaatactaattaggaaacaaataataaattagaccataaaaatgtaaaagaccttgtggccacttagtgcacactctcccttttcagatgatagctgcagagattcacatagttacccctccagctaatccagagcagagtcctgaccgcaggctcaccacctcaggtttcagttcattccatcaaataatgatctgacagtgggagcaaacctactcaactgactagataagcatcttaattgaatcagaatatcaaatgcacatgtttagcatgtcatagatggacagatgcattcaattatctcgatttttaaaaagcctggataagaatcattttaaaataaataattaaactgaattctatctttcaaaccaacacaagactaatgaagctatccctggcaccttccttctcttttaaggcaaactacaaagttaaacttcactggtcaatatgccatgcaaaatttaagtaaaaacgctataaatatttgatccaccttttggaagatagtcctaacagctattaattgcttctaggattgttaatagatcattctcagaattagtggctcctcctatgaaaatcttagtgaatatatatatgtctcttaaataatgatttggtattttatgtagttctcccaatatttcaacaattgaatagcatttgttcattaagaatatgtactaagcacatgccataagcagacacagttgtaggcactaggttaaataaaacactgaaatagacatggacaccagcccaaaataaaccaatgataccccaagagtttaagattcagatgtaaatgttttttggtagctattacagttaacaaaaccaacataattaacatgttctaacaattttcattgctaaaaactaatacaggaagttctgactaataataaaaaggaatagggaaatcaaattttaaactttttatttcaagaacctaagtttttattttccaatttagtttcaataataaattgaattcaataattaagtatgcactgattttagcttgctattcttgattttaaccactaaggggcaaccttgtataaggattcaaatttcacagcccggtgtaatttgggacttcttttccttcatgaaattaaacaaatgcatttgctcctacttatgaataaattgtgagattataggtgatttttaaatgtcttctttatattttttctaattaaagttatgtaattattaggaaaaatgtaactgtacatttttaaagatgtatatttcttttaagagtttaatgggaacaccaaaaaagcaaaaataacactgtctttgtatttagtaatcctactttatgtaaaactttgggattaatttattttttaatgtaactttcaattttaaggcagtaattgcacacctagtactgattatagaaaaacactaaggagttaaacatctaaaaatttcctgagtattatattaatatgtaataattgtcagatgttccactggaacttgaactcatgcatgggggatgttaaaaatacaagctcgaagcagaaatttaataaatctgaggctttgatacaataagatattaaagcagtttatctgccattcttttattttgttgatgttatatggcaaatgatcataaatgtttcaagtccaattataaagtggctcctgttttggctttctaattcaatagctacttaatgccttggagtaaatacaaaaggcagagccattttatttattcatttaatgtataacttttcttgttccagaaaagacttaagacaatctatcaaaaatatgaattttaaatatctcattttattcctctttcaaggtggcacctaacctgtagaatttttcagtagccctcaatttttgacattcactttgggtcattttctttcaactgtttaacaacattccctgcttagagccattaagttagttaattacatgagttccttaaaatttccagttttggagattgtcactatttcatatatatatatatatatacacacacacacacacacacacacacacacacacacacacacacacatatgtattactcttattacaaatacatgttaaatttgtaatactgtgggacattattgcctgtcttatatgaattcataaatatcacttgaattgttcagagattgtgtcacaaaccaacctgggctttaggcttcattttctcacctcttatgtggtgactctgatccagggattaaaattctctaagcctcagaatttccctctgtaaaacgtgattaatcattcacttacttcattcaggttacttcactgggtttgaaaaactagttacttcatgaaagagtgcatatagagacttggcacagcatctgagagtattggggacacgaataaagtatataagtggttattaatactttttataagagagcaatcatcccccattggaaattccagaagcttttgctagctagtttttctttctttctttttttttttttttttttttttgagccacagatctcatttttcacaatttaatacttgcactgcttgctgtgctggatacttagactgagaccaaaaaaaaaaaaaaatctgggtatttcattgctgaaggcagtgaagaggtaataatagccaacatttattgtgggcttactgtttagacagaattgggttaaatgtttttcacatatttctcagttgatcttcacagaaatcctctgtggagtgcatattattgtgattttctcagttttcaaagtgaggaaagtgagtattagaaaagttgagtaactggtcccatgtaatcatacaagtcgctagaggctaacagaagatttgataccaggtggcctgactgccaaccctgtaatctccaccactttgattcatcttttggttaatgttcatgtctgtgtctatttaaataattctcccataagtatttgatgctctacaaggcaatactgttcaattcacattttattctctaatctggtttaatgaaccttgtatgctcactcagattgcccaaattacttcattctccctacactgttggccacctttgcaatacactgtaagtcatgtctacacagtttcaagtggtctaactatgaagttcctggcaattcctaatgatcccctgtagacaggtatgctaggtgtgtgtttgcaggtatgtgggtgtgcattttttctgagtgcataagcaataccattcaagagagaagaagacagatttctcacccaaacgttattttccttttttaaagaaaaattttattaaacatatcaaaaaaggtctttagattttacaaatatgtatttaaaactagatcatgctgtgatcttgtacagaaattttgtttctgcaagacaagaaaaaggagaggaaaaatgataaaacagaagtcaatttgtttttttttttgtttttttacaatttaatcttttatttttatttacattttatgtagaatgcttataactagaaagaaaggtttctttttttatatactttaagttttagggtacatgtgcacattgtgcaggtcacatatgtatacatgtgccatgctggtgcgctgcacccactaactcgtcatctagcattaggtatatctcccgatgctatccctaccccccctccccccaccccacaacagtccccagagtgtgatattccccttcctgtgtccatgtgatctcattgttcaatatttcattgtctctattcactattttggttgttgttgctgtttttgtgggttttcttcttttcttttctttcttttttttttttttttttttttttttgagacgtaggttagctcttgttgcccaggctggagtgcaatgacgcaatctcggctcactgcaacctctcccaggttcaagtaattctctggcctcagcctcccaagtagctgggattgcaggtgcctgccaccacacctgaccatttttttgtatttttagtagagatggggtttcaccatcttggccaggctggtctcgaactcctgacctcaggtgatccacccgcctcggcctcccaaagcactggggttacaggcatgagccaccgcacccggcctctattcactgttgaacaagaaggttaagattatccagaattatgtgggagaaaacgaggacggttgggcaataatccttggtaagaatcagattcgagccgaaaaaaattagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatctatttagctattaaatatcctataatgcacaagacagattccaaaaacctagtattatctggcccaaattatcgatagaaccaagcttgagaaacgtcctcaagaaagatattaaaaaagagacttagcaatactgggactagccactgcaaggttttaagcatgatgtattggaaacaaagagatgttatattgttttgagcatctgagagtattggggacacgaataaaaagaaactagatttttcaaaatgcatatccaaaatagtttaagtagtagaggatgggttttatgtgcttcttgaatttaagactcttaaattttgatgagcagtggaaaagagggagaaatacataaaaagtatacaggctcctggcacagtcttgtgacacacaaaacatacaaaagcattcggccaatgtcaaattgctctatttttcttatcagtagttagttggaaaagagttaattagataattctatcatacttcattctgtatgaatatataacttttctgatcccctttttactaccttaataaacctttactgatacctaactgctatattttatttgctatttaccagtgttaaacgaaggaaggtatctatgttcctgggtgtgttttcagttgggctagcttcttttaagatcatcacacttcccatgtatagaccatgttagctgatgtcactctctagcctaacttctcatagtccttactaagcatttgttgataagaatgccaggtgaatggaattaagcatatatatatataagaatgccaggtgaatggaattaagcatatatatataatataatatataaaatgtccattctgatcacttttttctacaaagtggtccaagaagatttttagaactctaaagctaaggggaaccaacttgaaaaccatataaattaaatgatatatgagttgtatttcaactctaaaacataggttccaaatcaaaggcattgatgtttttgtccatcattcaaaatgcttaggagaaacctcaaagaaaatggtcttttgagttttcatttaaaatggccagctgatcaaaattggactcttcagctgtcattctcgttgtttattacatacaaaaatagccaaatttagagattttcaacacgtctactcttaatttatatgcaaacacactcttagtaattatcttagtaatcttagaaattatcctggacaacttgccttatttatttttttgtatgtccaatgacatcacttcactttaataagttgttttgtcattttatttatgtttttgactcaatcttaatattgatgcatttcttaaaataaccctaacaaaaactagataacattagagaattactgttaattatgttatgtgtgaaaatggttttgcatacaaaaattggcctagggtggtggtgcacacctgtaatcccagctactcgagaggctgaggcatgagaatcatttgaacccaggaggtggaggttgcagtgagcccagactgtgccactgcactccagcctgggtgaaagagtgagactttgtctcaaaatttaaaaaaaaaaaaaaaaaaaaaaaaaaagaagaaaaggaaaatggttttgtgattatgtaagaaaatgacctcaattttttgagattcaagctaatgtctttagaaattgctgatgagttgatgagttgagtagtattgatatcataatatccggaatttatttttcaagtgttcagtcctagacagaaagacagagatagtggacagagagaagtaaatatagagctagttagctagacaattagataaggcaaatatggcaaaaagtttacaattgttaatctagttggctggtttatagatggtgatagtactattctttctacttatgcttgaaaatttaaatagcaaaaaaataagtaaaataacaacatatcatatatgaagaagcaccacatctacttaccaaacactaaatccagttatctgatctattaagcactaccttggaaacagcttgacttggtgaaactagggctatatattacctatggagccttccacaagtagcttaatgtaaaatctcaaggtccttatttctaaaatgggaatattaatagtaaatctttgggtagtgttacttctggaactcagaagtgaaaaggagatagtcctagtttcattattagggctatgaaattataaatataattacataaattgaataagaaaatgtatgtaaagtagctagcacattgctagacatttaaaaaacattcagtaaattagatttggtaatagtaggagttcaatagtagtatcagtagtggcagtaacaatagaagttatattagccattttaatagtaataggagcagttttagtagtattaatagcgacactagtaatattagtggctatagttatagtagttttgtgtcttcctctgtaaaatacagctaaaaatagtacgtatctcataggcttgttattaagagtaagtcagttcgcatgtatatttataacaacctttgacacctagttaaccctaattaaatatctgctgttagtagagttggtggtggtagtaatgtttgcagttggatatgacatatttgctatagtatttttgctttctctactctaacaagccaaaagtaaagaagaaacgttttattatttcatggatatagcatatatcagacatatttaataatttttatgtttgtgaaacatattctttaaaggatgcacttctttccaaacatctatatctctccctttactctgaacttgaatggaacaaattatttaaatgacaattatgagctctaagttttatctagaccttttctgtaccatatagaatctttctttgttcactaagattaattcaatttgttaatacagcgtcatcactgagactcatttacattgcagaaatgattttgcagttagtttacgggggaaggtgaaggaagggctgggtatttatatgttggaagtcttttgatttaaacttgggaaacttctaagtggtcaaccacatatacactttggaacatccctgagctttgctatcacaatttccagtatgtgattcaactctcctcatctgaagggaggaattttgtaattgagccaagctgtggcttttagtaaaaatacagtgagcatttgtatctaatttgtggctagaatgtgctgaggcccatgatctttacttgctttgtaagcgttctgccaaccactgaggacctcaacttctcttgaggtatggaaagtgctagtagtatttacaaaaactttaggagtgctttcatacatacacaactatattgggaatgatactttatattttttcttctttccttctgagaagttttattgctacatgttcaccaaatgtagaaccagtgagaataaacattacagttgcttcttactgctttatgcaagtgggcttatcgataaaagagttaattttcaaactagtttaacattaaacttttagagtagtttaaaaatcgtaaaagagttcatggtgaaaaattaataaatataaatttaatataatgtattctaggatataaaacagtttgtgctttttattacatgtgacagtataagaagaatgaccacattattcctatcagaataaaataagtgaatgtataaacagcaccatgtttcaaagagagtttagggaaaaaagatagcaatttcattaagaaagaaagaagattagatacatcacataaatatttttaaaagggcaattatgataccacaatatgtttatttttatattactttctgccctcaattttttgttgtaaagttcaatgaagaaacattttaaattgctaaggtgatttttttgaaaattcaaatctaatgacatggctcattgaaatagtgggagtttagtaacagggttatctttcaattagacaccgaagcaaccaaagtactgagttcatttaatgaataaataccaaaaaagtgctttttacttgtatgcagacattattctttccaaatataactatcattttgtgtcgtaatagtttgaaagattttacttaatacatttatattattgaatatttagtatcaagtgcatttgtattaaggatgtcaagaaacatcaaaacagtctatttaacaaatatgtaatgtttattttattttacaataattattttatattttatttttcctcactaaaaattacttagacatatatgtcaattaacttttatgatagaccaagaaaaactcatatttaccttctctatatatgaatcttattctctgcttacctcaaaaaaaattttaatataagtaataaaataacatcttttacctcctttgttagatgaattctatttagtataagaagttaggccagctgcaaagttgggcacagtcccccaaaccaccctcacttctgacaccaactgcaagttcaaggggttgcaaaaatcaccctcagtttccatgcttcgctagaaggtattcacagaattctcttaaagctgttatatacatgggtacagcttcttacaggagaaggatacaaattaaaattagccaaaggaaaaagcacacagggcagagtcaagaagtacaaaacacagagcttctattatcttctccccgtgcagttaaaatgcattactctgactgctctgatgtgtgacagtatgcttgaagtactgccaaccagcaaagcttaccaagcctttctgtccagagtttttggggggacttcatcaactagacatgattgatggactcattgctcacatggttaatctcagtctctaggttgactgataccacatgaatcgaagaccctactctaagtcaaaatgtcctatttgtggcatgaccaggcccttctctaagactctacaggtgtagttaactcttgcccgaaatcacatggttggattttccagtatgacccaactcctactctatgaccagccccagcttgaagactatagaggtgtggctaacccctactctaaatcatatgattggactatcctgtatgacccaagacttcccaagcaaagaaagatattatagagattaccttctagaagctgagggcaatggcaagacctctctttgggcaaggctaaactctttactacacataggggtgggaaaagttagaagttcagttttcttgtatgttagtgatattgttttctctataaattttcacaccttcccaataacctttctattttcttatgaaaatagtgtatagatatttgaaatatatcattcctggtagtttatctcatagatatggatagcaatagtttttctcaagtcagttattttatctcataacattatcattatcttacctgaaaaaaccatttgaaattactgaaagaatgtctatttaataaaaacactttagattattttaatgtatctattcaatatttgttgaattctcttgtatgtcagatattacattaagtactttgtatgtaataataaataagacctggttctttccttaaggaattacagtctagtggaagaaatcaacagtgacacgattacggtagaaaggaatagttacaatgaaactgtacagagggcaataactaatccagccttacaatttcagatatgggaggggtatccaaaatgtgggttgaacattcatagccaagtaatggaagtgggaggtggggcaatccaggcaatgcaagtgatatatgcaaagttttgacgtgagaacacatagcaaagtataccctattcactgtggctggggcacaggagttaggtgcaggggtaatctgtggaggctgaaggtgtgtgtacttcactctcacacaagaaaagcctcattatttgtttagtaaatgctgtcactgtcatgggttatatgtacttgctaacataattctgaatgtagctgaaaagaagtgaatacatattatcttaagagcagataccaaaattcttgacaatttgacaagttcattcaaacaaggcatatttagcgtgattatttgcttggcactgtgctggacttgagaagacagcgcatacagctgtatacatatataacacagggatacaacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagacaatgtgatgaaccagagactgaagagaacaagatacatttgtggtcctaaaaagagaatgttctgcctggagagcagagtgtgagtgagatggcacactaggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtggaagtagtgatcaaataagatgtaggggttcaggtgagagatgtgggtagtttggacaagaggcagtagtgatggaaagaatggataaattcaagaatttatgatgagtttatgagaaagttgaagaaagggaggggttaagaatgtcctagaagttcctggaaagtcagatgactagaaaaaaatgagtatttgaggaaggaaagccaaatgctatcaagaagtcaaataagatgagctgaagcagtgggactcagatgagaattgattgaagagtaagaaatgaagaaatggaaaaactaaaaacagaatagatattgtcagaatccaagtaaaaatcaaacaatcaaacagcttaatatgagaaaataagaattatttatttccaagagaaagaagagaaaagaagagagaagtaagagattggtagtaggagtggctgccaacaagatggcagagcactgggagaggtgaaggttactgggaaattcccagtaaatttacggccaacaggacttttaaaaacagaattatgcagtggatgatacttttcaaggttgatttaccctaccttttttttttttttgatataaccagttccagctccttcagttgttcagtaaactaactttactaggtaagacttcatgctatttggttttctgataaaatagagaaagtgctgaatttctagtctggagctccctggtatgacaaaaataaataaataaataaataaataaataaataacagaccaagaggacagaaggaaaaaaactcccctattgcaggaatttgtagaaatcttgggaactgtttcaatttttgaccaatctatacctcaagggactggaagatctcaatcgacattaaattaagactggctaatatcaaggattaaggtgtgtggccactgatcagttctttatatggagatattaatattctgttccaactaactataccaatatgctctctcagctattattcttaacctcattaatccagcaagggttgcaaacccaaatgttttccaagaactggagggaacatgatatatgaagaggttattggtagaacctatggtgaagcaaaacgttcactccatgtacagtcatgatacatcataggtatctagatatttatcactgaaatagtaaatcaatatttttggttcataggaaaaccaaatgtccatttaaaaattgagttttccaagttttcattctaagaaaatatcttggagataattaacatgaactttgacatgctcctgctaccatacaagctgagtgaccttagttatcttagttaaattacttggattccttaagtctaacttttactgttaatcaaatggatataataagacctatctcatagggcagttgtcaaaaaagaattgaataaaagtgtgtgtatgtgtgtgtgtgcctgtatgtgtgtatgtatgtgtatatgtgtgtgtgtatatatgtgtgtgtgtgtgtgtgtgtgtgtgtgtatgtatgtatgtatgtatatacttgcacagaccaggacccggtatagagtaggcattgaataactattagctatttttggaaattacattgaaatggtgtctcatcatcacaagcaaaatttcctcaagactcaaaaatatgtgttgaacactcttggaggcaatagaatagagcattgaacaaaacaaatactcttgtcctcgcagaacttataatttggcaacagagtacatgttagtggaattgtacattttctcaatttctgcaaacttttagtatctttgtaaaatgaactgtggcacatattaaaactagtcaattagatcagctttgtgaaaccaaatcaatcattcttccaaaccatatagtatttgtttgtactcattgatacttaaaacttattgatacttattagaccttaatatttctctttaagagatatcaatgaaatagtttcatcccttgagtttctctcgatataaccctctgattgtggaaataatagaatgttaaagatatgaaagctaaaaaataccttatcaataaattattcactttatttttcagttgagaaactgaagcctagagcaaggacatagagttagcatgtctaaaacacattctttaagtggtgttcattttgttaggggaaaaaactacctcttggatcttaaatgccacataattggtgaaaaatgtactgatttgaataattgctgtttttgctaacagctggattccaatggggaattactaatccgaaatgcgcagctgaaacatgctggaagatacacatgcactgcccagacaattgtggacaattcttcagcttcagctgaccttgtagtgagaggtaagagtttcaacattttaaaattacaaaaccaaaagtatttgacttgcataaacatgtataatcttctggtaactctggtgcaaattcttacatatttagagtctcaatcccatgcttaagaatggatcttaagcttcttcccatgcctaagaatgatctatgccagacaagtagtaaacaacactgattttgtttgttttactaactacgtatcttctagaaagttacaccacatatctcctactaaatgtttgtgctttgtagacttaccaaaagttctcgtttcctgctaatactttttagtgtgttgtgtatagtgctgtttccttttttatttctatggaaaagatatatactgatgctgtttactataacctcaactgttatatatttatcacttttgtcttagagtgtaaagttaatttatacatgtatcatgtttttatttgttgctggttttttcaaattagtgttttcgttcttatgaataatataattgagattgtgatggaatatacatttattaaaaatgcaacccctttgctactggccgctgccatagcagtgaggctggctgggaacacagcacaccttgtttaaaataaagagctggctcttcactgactgccctttagttttgcacccaagaagtaccatgtgttgaccccagcttgcttacctttaatatctcacttcatgtaaccaactccaaccatctaactaatccacaaaaatacactttaacttccatgtcagttgctttattcacagtattccttccatgtctttttctcatgatttgttgaccaaatcttattcatccttcaagtcttaaagtatatactaagttcatgaatccttctcttgatgtccccaatatgagctccgatcttctgaattttcataacatatattgctttctctcatatgttttatagcagttggtacacagttatctactctcctaagttgtaaaattcatatatgttttttttttagtgaatggcagagttcctttgcattgtttcgtagctctctctttctgtctcagtgtcagttaaaattactattttttcacatttcacctactaaaaatatttattgaacattaattgtacattttgcctttacttttcacactatcagataaattggcaataaaatgatatttgtggcttgtttattttaattctccttccacatctgggtcaatataattttactcaatctcatgcagctcctgcatttccctctagagcaatgttaatatggggtccctaagcaacactgggcaaatgctgaaaactcttctactccatttgaatatattctccaatagagttttaagaagtctagttgaagtttcttcatctgaatgaacttggaaatacattccacaaaccacttattgaataataacaaataaaaatgagactacaaaatcctaagtcaaacaaaattcatttaggttcagtattttcatttattttgttatctgggacattgattgttttcaagaattattagggagagggattagagggattagttcaccattcttcctagtcagaccactagctgttaagtcatttccagaagtagccaaagtgtatatttaattgaaattgcttgcatatgaaaataattagcattaatattgcaataggagttatgttacagtgtgtggacataaatgtcttcatatgattacattgtagtaaactcatagtactattaccatagaatactctgtaatattcagagtgaagaggaattttacagatgaaatgcaagggtagtcatgatactagccacacatacttaggtaattaattatcaccactatatgtatttttatagagaatcaataaaaagaagctatagccaatattatgtagaaataaaaacgtatacagcattttaagtccttgcactatagtaggatgctaataaaaccatacaggtacatgaaaatactgcttacctctgttaaagtcagcagagtcataaccattcttcaaactttatttctaataatagaaaaagtatccatttcatatcaaaagaaatttgcaattaaaatagtcaaatatatttgactattgcagaacttgtgtcaaaaacatgtatagatgttctaatatgctttatatatttaaaccagaaggtagacaattaaacagttgtttttattttttaataataatggtgagcaatgtataagacatgccctgccttaagtgatattattattggtctatttattcatttaattatacttttgtatctagttcaggaaatcataacctggagtctatgaacaggctttaagggatccatggaccaccagaaattgtacataaaattctacgtgtatgtacattttcctgggaaaatgatttgtaattttcataagattttcgtagccagcaatgtcccacaaggcattaaaaagctaatctattttttatttccccatctagatcaagactctctaataaaataaattgaagagatgattattcactttatgcaaaagaataaaatactaatacatttcatgtagttaaatctaatagcacatttagattgtgaattgcttttaaaagattcgatttgcactcaacccttcaaaattacatgtttgtaaaaaatattaaatatgttatgtagtagacagtagaaatctataagaactttccatatttgagatggactaattttaatccatattcagatattggtaatctgaactgcagctgctgaaattagtggtgcaatgagaaggacagtaaacacagtagaggggaaagcaatttcatctgaggatcgctaaaaaattttttataacaaaattatttctgtgtataaatgattatgccttatcagagaagactgaaacaaaagtataaatatttagacataattaagattgtggatttcttttagcctacatcacactgaaggaaatgaatacatagtaagaacagtgttgctgccctaatcaacatgtgtgtgtgcgtgtgtgtgcatgtgtgcacgcatttgtaattgtgggtggaaaagggtgagtatatgcatacagcatgatgaaagcaatttctatcagaaaagaagtgtgttttaatttattccttgcctttttattgtatattgagcttagaatgtaagcagtcaagtagttaaatctgaatgcctctaaatataaaactaaaattaaatgtaggaaaaatatagtcaatggaaaatgtagcattggatctgatttcatggggccttttactgagagaaaacactcccgctgtgagttttttgtgtcatgtatggtaggatttagaaatgaagaaagcagtggcaattgtcgccaaagaaaaacaatctgtagaaaatgtccccgataataagatatgaactattgtaattctgtaaaagcataaatgtgtacttatagaaagctatagcactttaatttatttaccatataactgggtccaaagatgcttgaggaaaagaggccagtaaagttgcatgcattgtctaatcctccagctctgcaaacaacttcaaatcatgagattgtattgaccatgtaattttcacttttcttttccaaagttggcttttatatgagttatatctgttaactttggcaacatttctgttagtctttctatagtatagagattatttttgcaagagtaacatttcttcaaatgctgttgtccaggaggtctaacatataaaatcgaagatgaagataaataaataaacatttgtgtcgtcacaaccctggcaaaagcagattatctactctgaaataggacaccttcaaccagccccctaaggattctaacaaatttagataaataaaatatgaatctatataaaaaatgaaaattgatggccaggtgtggtggctcacaactgtaatcccagcactttgggaggccaaggagtgcgtattgctttgagaccagcctgagcaacatggcaaaaaacccgtctctaccaaaaatacaaaaataagctaggcatggtggcaagagattaaaatgctatgcttgatatgatgacatttaaataacttatagaagattttagtgaaagtttatttttttcctatgaagaacacatattgacctcaattttccaattttccaaataatattgttggtgaaaggagtaatttcagaatcacccctttaagacaggggtttgtataatatacctgaaggaatttagaacttaaatcactatagattacttaatatttaagaggccttaaatatgttgcgttatgtttaaaatgtttaaaatatttatattttaaaatgttaatattaatatttaaaatgttaatatttaaaggtcttaaatatgttgccttatattgccttagctttaaaataagaaccaggtattacacttcagatgtttttaggcttctggtataaaagtctacattaagagtattgatacaaatttcctctgttgttgcaataaaatttttatttcttaggtcccataaaagtatatttcgggttgcctcgtcaaagtaagtgtctgatgcttgtgaacagccctgtatgaatattttttagcaaacaacatttctaaagctcttcagctaaaagagtgtcatttagaggcaagagttttgcaggatttatacagcaagatttattttggaaacctatgtgcagcttgccaaatctaaattctcattcatgagtgcacctttggacaacattcaaaaatagaccataaaattaggccccaaatgaaaaagaaattaggctttaacttgtacatgtattaccactttctctggtatttctgatgtattataaatattttggcaatgcttctggctaaggaacactttcctgccacctgggtgaacaaaacatgtttgccactgaaattgccaaaatagaaaatgcaattaagattatatcttatatactatatatttgtttacatcttatgtgttacattaaatgacgtttgttcactcaaatctgagtttaaaaacaaacaaaagaaaaagaaaacgactttgctatctaaactttttcttttggcctggttctcaactctaacatatgctgtatagaattttaaaatgttttggaaaaagagtagctgaaactaaagcaaatgatatgaaaactctgtaaatcattttctcctcaaaagaagtttgtgttgtttacattattacattagaagcttatttatttaaccttacgtggacttgtatttaggtgaaaacaccgtgtaagtgagtgtgtgtgtgtgtgtgtgtgtgtgtgtgtgtgtgcatgcagctttccactttatttctaaggaaaaaatacagttacagaatggagagagatattagttagaggtcatctttattgatataccctgttaaggtttttattgcttagcctaatgacgtggttaccagattttttcttaagaaggctatttagttgattactaaaccacttttaaactcttggataagttaaagtaacacggtcgaacaaataaataagccaataagcctgatggaagctgtcagtatacgttttagctggaataatattgcagtattttaaagtactataatagttgcctaaaggtcttttctatggaaaatgctcttgggtattttactcccagctggtttacattagcagagttaatatccagagtatcccactcttcactgtccagacaaaattagttctgaagcatttacttggagatgatggtccaggaaaattagtattctttttttgtaagaaatatggaatagataaacattttctttctctaagataaaagtgttctaatggtcctattattggcaaatcatgtgttagttacgtcttttctccttcccactttttcacagtaactatatgaaatctctgcatttatgttcaaatttgaaaatacaattttaaatgtagaactaatcctatgggttatctagaaagttcctaccccttcatttaacaacttggactctgagagaaagagttcctcccctgtattttccatctacatggtggcaaacaataatcttgggaccccagtccagtcttctcattgtactagactttctccagaaagtatggataaataaaatctatagttaatttctaaaactcactataccagaaagattatcaagtctattctggagctggtaggacaaattcttttactaatttttactaaatagtaaaagttattgatttcagtttctgctcttttctctttctgttcctactatctggcatatgctaatacaaaatatataatttttaaaacattgtaggaaaaataaagccaaagacatgcattataaacagatgtaatcattaattcttggattatttagggttctatttgcatgactagctcagggaccttggatattagtgagggccacaggaccgcatgttgccatgtgaaaagtttgtgtaactcttggtgctaaatcagattttaagcttctgtggtatctggcataaatgttcacattgtgttcaagaatccttacattcaacatattcttaaataagcaaatatggctttatgtttgaaattattattaaggtatggcaggccaaaataaattaaaaaggacttttaaattaagcaatttaagtattatgtagttgagaagaatagacataaaagttctatataatatacacaccaagttaaacaggcgtgtaagtatacacacctcatcacaccacacacacacacacacacacacacacacacacacacacacgcacgcattggaagagatccaggaaagagacgatcatataaaggcagaaagatctgggtccaaatcatcacagtcaaatcaaagagaatggttgaggtagtttttcaagtatttggggcagaaaaacacacatttacctcagatatttggataattgcctccactttccacttgctctggccaacgaagtcttgccacagagacagactagagattccatctcatcagccttgcagaactgagacaggaaaatggtccttgctgcccacactggctggaacaatgacaactgggcgccattctgagccatcctgaccccactctgcactaaccacagcaatgcatccattgatagcaaaacctgcctagaaattaagccttccccttcccactgagaatcaacaaattcagatcaaagaaatacgactgggctggttctccataattgtaatacacaaaagctaaaatattgagctgaaatgcatatttggttataacaaatgcagaatttagaaaatttaaagtcagaacttagtggttatttaaacaaaaactctagtaaaaatgacagctttcccaattacttctggaattttaaagtacatcaataatttgaaattgtatttttcaatgcaagttcagcgtaaattgaggtacactcaagaattttttcaaatatggccacaaaataggtaattcactcagaatgattcacattattttaaattttaagataggtcttgaaaattatctagatgaacacttcatcttacaaattcaaaacttaaaatataaggataagaagatactatgttatgcgctaatataaatttagatttttctttccctccacactagagtacagtgagaaaagctcccgtggaggatttcttcttttctgcaattaattactcccgggtctcttataatcaaactggtcagcttttggcaaactggaatttctttttttgctgcacatttagtgtgtacccatggctcccttaaaaaataatcggccaggggaggcagaggcaggagaattgcttgaacccagggggcggaggttgcagtgagctaagatcatgccactgtactccagcctgggcagtagagcgagactccatctcatctcaaataataataattataataataataatcagcctggtgcagtggctcatggctgtaatcccagcactttgggaggccaaggcgggtggatcaggaggtcaggagttcgagaccaacctgaccaatatggtgaaaccccatctctactaaaaataaaaaaattattgggtgtggtggcacatgcctgtagtcccccctgcttgggaggctgagacaggagaatcacttgaacccaggaggtggaggttgcagtaagccgagatcgtgccactgcactctagcctgggcgacagagtgagactgtctcaaaaaaacaaaacaaaacaaacaaacaaacaaaaaataacccttctaccactcagtttgattccagggagacagtaggaaagctttacagaacttagcaggccttgggagcttttagacactgcatgcatttcagtgctccatagtgattcatacatccatgcgtatttaccagataattatgccaaattaggctacaattatgccaataatgtcaaagttcaagagcaatacagataatcagagatacctacaagtctcgaagaatatgaataaatggcaattagttcatattttgaaagtaattgtgatgtatgttggtaaaatactacatttttccaactcaaatctttaggctgtgaaaaggtatttatataaaatgatgaatataaaatgaaaataaagatatataattatataatttaatatataatgacagaatgtaactacatagcatgttataataaaatatatattatatgtcatataacatgtattgattatatcataaaatgatatataacatttattaaagacattgtttaccagatttaattttaaaggacaggtatcgttactgtattatattcattttacacatgagaaaattgaatctaatgaggctaagttaatcactaaaggtcacaaagctactaagtggaagaacaaggtttgaatgcagacagtctaatttcaggtagaacacccagctcatggctgtagcacactataactaaaacttaattcaaatatattcaatgtgataaaataatcagtgtggaaaagctaagctgctggccttttactttcttggcaataaatgtttattctatagagtgtcactgatactgatcttgctattttatttttgctcatgttatatttatggctggcctattacaagggaaactatagtagttatttttttttcagctactcaactttacacagttataattacaatagcaaaaccaataaatgaattgtactagatggcttgaaagcttgattttataatgtgctctttggcctaaaaataggtaaatgaaattttgatgtgtgttttcctgctttttaaaataatgtataattcatacagttaaaaatagttcattcagaatatttaaatatcttagattataatgtctacacttataggattttcctataaattttaccacgtcatcctacaaaattgctgtgaggtggtagtacaaggactgttattcccatttcataggcaaaggaagtttaaaaaagaaaaaaaatatattttcaactatcagttataaagccagaatgtggccagatactagtgttccaaattcaactacatgaatatgcttttcccttcttgatgtttaatgttcccaaagacagaagtcagaccatataattttgtattgtgcatctctatcattgttggtacatggtttgtcaaattaattaggtaattccctcaaaacactctgagttattgataattccaagttaagttagagagtagagtaacattttagctcgtttaaaattagaatttcattaatagtttcccttttcagctcattttactaaataagacaaaaacaccttagcctcattgctgaaaatataaccaagaaaaaacttaacgacgtaaaatccctttcgagcagttttattacctatgatttttgtgcagtctgccatttccagtctcgtgactatgcagtgctttcttgagggagccttttgtgggcttgctttccacccagtttctggaaatttaatttggtcacaaaagtttgggcatattagaatgaaggaaactcagaaaaagcttttaccctctaaactcatcatcggtttatgaagctacagagagattttagtgcttttgaattcctacaatagcttctccaactctaattgtcactactgggattaaatgaaacatacacagagagagaaagaaatgtttaagtattctgcaactgacgcttagctaggataccccattagatcagagcagcaaggcacagttctaaatcttttctctgccagagtgcttttccatcatcatgtttaactgtacactatactctcataactgattgcagattttggcataaatccaaaaaaacctttttcccctaaaaagcacaacactattttaattgttatttgcttaatgccagctaacagtgatgatcattgtgtggacatgggaagacataagggagtggctgaggttcatgtgcattttccagggcacccctgaagagccaacaccttcacctaaaagtgcattgggatgcaagtgagtgagagttagcatgctaccaggataactttgaatccactttatcctttgggaaaaaaatgcagaaacttctgaattctcaatcttattagtagcaaattacttgtgacacaccagagtgtagagatcccttgtgtaattattcccagaatggtctaacgtccgtcactctgaagaacccacttctgagcatctgcttcctgcactcttagcgactctcaataatgagagcttgaccccgcccctccttcacacattcctgagaatttctcgagaagaaaggaactgttactgatagaaatatgtcagatcccgctgatgtgtagggtctaagcaacttggaggaccactatttgatatctttctacattgtctggtagatacagtgactaattcaaggaaatggcacccctctctggaggagtttaggaaggctcccttggtgactgttcacagcacccccttttcagacttaaaatctcaaatcacagataagcaaactctggtaaaataccaaaaactacccaaactgcgttcaaaagaaaaaaaaaagaatatatctaaaattaggattttcagttctcatcaaaaggatttaaaattttatatgcttaaaatgtcaaatgtcttacgaccttttttttactatttaccgtaaggactgaatttacaacaagcagtcagcataggcaagttttcctagtttccgtttcttctatttaaatagctatctccagggggcagtagtggctataaaatggtataattctaataataactatccttagttatgcgtaggggaatgaggtaggtgatcactctgttaattacatggttttctataacaatattgctgtattaatatacacatactgttgttaaatgattacatggttttctataacaatatttctgtattaatatacacatactgctgttaaatgatttgcatggtgtgatctaaaagctgtggcctttggtattaggtaaatcgattagatatccactttgcctacctaacctatggtcttaggctagtctattaatcactgtaagcctcaagttccatatttatgaaagagaatatgagtagttacagtccatacattgttcatggcaactttttataaacattgtcctttacttccttccctttactatgaatgtatatatcgacataagaaataaataaaatataactcaagacacagttctcacaaaacagccttaaccgttgattaactttttcaaaccattgcttcaatctatccttattacttttattcttagaagtcttcaaggcataaccatatgtttcagtagatagacttgcactctgtggaatgaaatttacaaaggatccacgagatttgtttcatttatttgttttttgaggagagacttcagttacaacgcttgctccttagaaagtcagtcactgtgtatgagggaaaggttttaattgggccacagcttgtggcatcggtcttctccctttggccccccgtcctcagtgtgtaggggaagatacctttctgtgtttattctttcaccttacccatcaaggaaatagggcaaatcccccaagtgcatggcttcctgcccctaattgggcatccacactctcccttcagccttgatctttcctcttgcaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaagatgttacttatttccttcttttatattttctagtctcaattactgttccaaaaggagctatcttagaacttagactagagatccagattaattgccatttttgtaagatgtttaaaatcaatttgagaattttcatgtgtctgtaaacagcaccatggagacatgtatgaatcgtattaagggcatctttccatgtagtccatactgaaattatacaaccaagaccagataggaatattttttattttattttattattacacttcaagttttagggtacatgtgcacaatgtgcaggttagttacatatgtatacatgtgccatgctggtgtgctgcacccattaactcatcatttagcattaagtattttgttttttaaagaaataataaaaattctaaaggaaatcataggacagatgtgacttgtaccagaaagggaaggacaaccttaaactatatcaatatcaagtagaagaattatacaggttcatttatcttcctttagtcttgttcttatttctaactgggatctaaatttacctttatcaatatcagaggttaagaaaattaccatattcctattaaatggtagagatatttaataagattcagcttcatcttagtacaacttcaaacatcaacatgatcagaaaacattgatttatattttaaaataggatattggagccattgtcttagataattttcaaggcaagaacaagcctgcaataaataatgagactttgacattccttggcgaagaagatgtctcctgccctaatatgactgtcactcagcaatttcaattttatgtttacttgatttaaaaagggaggataaattgttctgaaaagttttttgtttccttaacatttcaaagttttcactgaaatttgttgttttggtaaaaataaacagttaactacagaatatttttacgtggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatgatacgtggggtgtagtcacagctactttacatcctgtttataaattgagacacgaggatcttaatttctagtcttctatccaatttgatttatcaaaaaaatgaatcttgattattgattaagaaaatatggtcagcttactatgtgtgaatggtcatttggaaaatttatatattgttttctcactatctttcctcaaatgtctaaattcctcttcattgaatgttactacatttttaaagcagaaatgacagaactgattaactatatttctcctcatttttaaaaattagtttacatatgaatgaaaactgagtaaaaatcaaatctatattttgttcatacataggtatgtttttctaaaaacattagtaaaatccaggaaagattaccaaatatatttatagcaatcaataaagagtgggaatgtattgaatatgaatttataaatggatgatgtgtttatctttacttatctgagttaacactgaaacaaagatttaaaaaggcatgattggccaggcatgatggtacacaccagcactttgggagactgagatgggatcacataagcccaggagctcaaggccagcccaggcaacgtggtgaaacctcatctccataaaaataaaaaataaaaataaaaaataaaaaaaagctatgatcagtatgttacagtttttgtcatattttccaaaatattcacttgtatacaagtaattcatattcttcccaaaaagaaaagtcagcaacggaaacctaataacatttttgaatgtgatactgacaatgctgttttaaaaatattgtttttaggatagttgttgaaaatttggtctcatgacaaattgattaggctcagattctaactttgacatttacttgctgggtgaacgtggccattttatttaacctattcctgtctgtttcctcacctgtaaaataggaaaaataatagcacttacatcatagggttattggtaagaattataaaagatttggcagtgacttcaatataagtactcagaaaaaagcataatttttattaaaatgtacagtataaatttcccctttttgaatgactaataattttataccatgtaaattttatattgttagcagttcaagtccaaagagaacaatagtgtagacttgttgtcatccaggtaattacttggaagtcttttgcagacaggcacatttaagctgtataatctaaatttgaaaatagatgttttctcattttgagcgtgttataccagaaaaccctgtctttgatcccatctctgtactctgtcactgattagctatgtatctctgacaacagcccttatagacttcggtgtccttttgtaaaatggattatatatatatatatatatatatatatatatatatatatatatatgttttagtggactcttaaatgtatgtgatctaccttaaatattgaaatgtttctattatttgtctgtagtgcatgatttaattgtaaaaatgttgaaaacataaatttagagaaagagagtaggggtgtggcaaatgagactctgcattgaaccatgaatgacagaatgacaggagatcattcaggccgtttccccagtcctttactaggttaaaaagtgacagaaacaggtctcagtagctgttcgtaaacttgtttttagtcaactttgaagaacccccaaggtaagaaacataacactaacaaggactttgatagatcattatttttgtatgccccataggtgaaattttatggaacattctcagtcagcattctctaagaggaatttttaaagtgagagtgaaagaatataatgggtgcaaaacaagaatagtaagagagggggtcatgcaaataggaaagaaagaatagtccatagaggcagccaccatctgaagtacagaaaggtagcccaaagaagggtagcaatttgaacactatgattttgaatgggaaaataagaatcaaaaaaatcaacactgaagtttgtcctgccaactgcaatgaaagaggaattcaatcagctggataggctgagcacaattagtggtatccactcttgatgacatcctgtgagcatttgaaagaatcaggaaacagaaatagcataaatagtagggatatgatatatgagcgtaataaaatgtatttcaaaaactcgagagcatgggtagggggaggtggtgacaagagaggagtgaagataaaactgtatttataaaagcataaaacaaaaagcatgctttaaataactttttattccctcctccatattgttctttttctcctctttcacctctttctaactccccaatattaatgttagtgagaaaaatggataaaaagactttgccaggtctagtcagaaatatatttcagttctttttcccctaacttcagatctttaataattacagccaaagaaagaaaaaagaaaaacagaagacaaatttgtcatctaatgtatctaggcatttaaaatcaggtcagattccaacagtctttttcaactgaccaatttctctcttttatgttaactttggggtaaacagttctcagaatccttagctatctggctgagaacagcctaagaaactggaaggagatatcagtaaagtaatagtgaaataagctgcatgcatcaggccatttgcttacattttccctggtttcctgaaggatttattgagagcgcatggtaatggaaactaaaaaaagaaaaaaaaaaaagaaagaaagaactcagggttagaattatgtatggttgggtttttttcattgacaaaagaatcagaagagtggtcagttcttaaatgccttcctttgtgctgagaacaaagtagttttgtcattttattttctacctcaacacttttctgtccattctaaacaaaaaaaataagcaagtaacatcagcctacactgcttgaaaaccttcctgctgagagacactgcagggctggccctgggttgaagtccgaccgtccacgtttgtctccgtgctctattttttgccacaaactgattccttaatacacagagtatcttcacattcccaaattttcctcacctacatcaaaattactggaaaacattttactttctatgttgtcctataaaccaaagagtatctgagacaagtctcaagaaagtttattttgccaaggttatgaatgcacctgtgacacagcctcaggaggtcctgacgacctgttcccgaggttgctgggatacagcttggttttatgtattttagggggacatgagatatcaatcaacacatgtaagatgtacattggttccatctgggaaggtgggacaactcaaaatggggggcttccagatcagaggtagatttaaggattttctgattggcaattggttgaaagagttattaccaatagaaaagaatgtctgtattaccatacagacttgtgggtggcggaaatcaaggttttctcccgcagatgaagccttcaggtagcaagcttcagaaaatagattgtaaatgcttcttattagacttaagaagtctgttctatcaataattcccaaagggaggagggtgtaatgaggcatgtctggctgccccttcccatcacttcctgaactagtttttcaggttacttttggactgcccttgccaagaaaagggttcctttcagatggctggggggcttagaattttatttttggtttactgtccctgctttcttttaagtaataagtggtaaatgaatactctgtaaacagatccctggaatgactgacaaagtactaattaataactcctgccaggtagctaagatgctcagaaatcttttaaagaagtaatgacaataataatattgttaatagataaggtttcctgatggctttctatgtaccaggctgagaactacattctttaaggacattatttcagtcctaacaatcatctgttttgttttgttttgttttgttttgttttgttttgttttgttttgttttgttttgaaaaggagtctcactctgtcacccaggctggagtgcagtggcgcaatcttggctcgctgcaacctctgcctcccaggttcaagcaattctcctgtctcagcctcctgaatagctgggattattaggtgtgtactgccatgccagctgatttttgtatttttcgtagagatccggtttcactatgttggccaggctgttcttgaactcctgacctcaggtaatccacctgccttggcctccaaagtgctgggattatagacgtgagttaccacacctggcctaaaaacaatcctatatgttcggtttttattactcttgttttacagatgagtaaacaggaacttaacgattttaagaaacttgcccaagataaatcagggcacagaactgaaagctgagtctatcttaattctaaaatccctgttttttaatacaattatgattttaatagtattatttttctcaggcatttttggggagatatttgtaggcaattactagatggaaaaatctacttcatatcagtggaaccattaccgagtaaaattcccacaccagggttttgaagataccaacacaaccctttccatttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccataagccagacatgtatccgagaaaacaatggacaagtataattatagtgttttgctcaacaatattacccttaaatgagtggatgactgaattattatgcatataatgtctcaacaaatacactaataatatgcagctttattctgacctttatgaaatattactcatttgacacctcaagaacatcagagaataacagcagggaaatgatttacattttaatggttaatgactaacctatgataattttgtcttaaattccctttaacgttttctgaatgccatacccctatgctcagaaaaagtaactgaatgcatgcattacagggctttttcttcatttgagaaattcttttattattcacctctaattttttattttaacactctgaaatattctacttagtaattgacttaggatgctgcattatgtgaagtaatgaacttcttggttctgatcaagaatgtacactgtatttcaatgtgttttcttacatatgaaaaatgcaatatgttctctctgaatatcaaatgtgttctgttatgtgtctattttcaattatttaacattaagaagtctaagtatactattataggttacaaatttataaaagttcgcttgcttttcttatatgtgatatatttccaaataataaaatttactgtcatggatagggtatgtgtcttgtgttattttaacattggtggtgatgtgtttttgttgatctgcacacactttctttcttgggaccactttaaggaaatgggtgaaggtttggggtgttggccatacctctgcaaataccaatgttcttataaagaaaaaggccatctaagctaagcaacccaactgatatataaatataaaggtatatatttcagctgaaagataaagacaaatgtcctctttagtattacattaattatgaaaaatgatggtgctacttaataaaaattattaattattatattaaatatgcctaaatcaattgggggtggactcctttctggtgcaaatagaacaagtgatatgtatgtttagttataaacattctgaaatgtctatactaggagctgtctattaactgagagacttctttagcttttgaagtgatagatgccacttcaccacttaaaggacatttttctcttatttttatttgtcttatttgaagacaaaaagctcttcaaagcccaaaaagttgtgtctcacttatcttttaatttctatttcccagcacagtgcactgttgaaaggaaaaaggaatcatattggtactgagttatgaagcatctatgaaaacctatttttaacattgttttttgttctgccagaacaattcttctaagactcttcaatataatttgaggttttaagagcattcctggtatatctctgaattgacaattattttctatatattatataagtagaaacatttttaatattacttattcttatgactataactaacatgaaatgtattatgcaaaatgatacatgaaattattcccagaaatttccacttcaagtaaaatgaattacctataacatttagagttataagaaagtatgtgggccagtgcggtggttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagaccctaactcaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataatctatatttaaaagaaatgcagacacactgattatattggacaaatgttctttagattaatggttagaagacatttttatattctaatgtgtgtttgactcactagatggaattcactgattcattacccacattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacaggtgagttttatttgtctgattaatccgtgcatgttttcaaagtgaattcttttctcaaaaacaaaaatttggaggttttaaaaatgtcattatctaccttgaaaggctttctttcttaaattttttaaaatgtattctaatattttggtaatgaagaaaattacatagaatttacacatttaaatgtgttaaagctatagaaaaagaagtatcatttctaaatcaatatataatggaaagcaaaatgaggcctcctgggtttcttacttgagttttgtgtgagatttactgccccaaaatcatcgggaagtctatttttgagcaaatagcatttatagcatagtatttatgaccctttttatttgggtatatatgtactatagttctgaatttctaaaaaaccacattgatcataaatcttaaattaagcatccaaatcttactactataaccctttatgtgaatgatctcacccggtttgaatttcctcaaaacagatttttaaagacattttggatctttcaacctttttcttttcttatattaagattttctaaagttgatcgggaaaaattaactaagaataagtgggtactttcctttgtctacaactttgccatttgtcatgactagcctacaatatcacacattaatacatatattttctcctgtaaaatggaagattgaagacctttttgataaaataacctgtttatctttgtaacttttgacaatatttttaaacaaacttgtcattgccagaattctttaagatggaaaagaggagacatagaaatattttcccagttgtcacaagaggagaaatgagacacgagtgtgtgaataaaatgttcctcctttttaaaaaactaaaaaaaaaaaaaatactctaatctcccaaatctgctttcattttagatttatcttaacataatggaaatcccatttccaaaatgcctatatttgtattgctcactaagatattttaatttaaatttacttctatttgatacttctctccctccagggaaataaatcaaatataaacttgaggtctgttgcaaggatttaggatatattttaatatcagatgattccccacctaagtgtataaagttgcaataaattagaaataggtgaaatatttccattacattatgcttattgttttaagaattatctgtaaatattcttgacaaaatcagatcatctgaaaaataattttaaaaaccttttagatactttataaacctaaagcatgggcagtttctacttttctgaagagaatggaaaagtatgataataatgaaactattagaaatctagccacattaaaataagtaaatggtttaaatttggtttggccctgaaaaaagaaatactaattgcaatcattttcattatttatgtatgcttactatgtagctcaatttaaatatgcttcttattttaaaatatccactagaaagtaagttccatgaaggtaaaaactgttttattcactgttctatctctagcacctatatcagggcccacagtgctcattcattaaacatgtttattgagtccccactgtgtgccagaacctattctagatgcagtatgtataggtgagtagcagtgaacataataacaacaataaaacctgtcttcaaggagcttatattatagtagaagagatgccaatacagaattaaaatatatagtaagtcatgtggtgatgaatgctagagagaaacaacagaaaagaggaatggggaagtaggagatgtgttttaaatagggtatttctcatattctcactcataggtgggaattgaataatgagaacacttggacacagggtggggaacatcacacaccggggcctgtcttggggtggggggaggggggaggatagcattaggagatatacctaatgtaaatgatgagttaatgggtgcagtaaaccaacatggcacatgtatacatatgtaacaaacctgcacattgtgcacatgtaccctagaacttaaagtataataaaataaataaataagtaaatagggtacttctgatattagtaatagccactgctgctttctgaaagttcctatttccattatatatcttttccaattcttctactttcattgaatttgggtctttgaatctaaagtatgttttctgttggccacatatagttggatttttcatccagtttgatagtctctgccttttgattgaattaatcaattaacatttaatgttattattgatacagttggattgtagctgcattgtatttttgctttctaaatattttactatttttgttcctcttttccttgttcactgctttcttttggaagaagtgagcattttctagtgtaacattttaattcctttgatgatattcaccgtgtgtgtgtgtgtgtgtgtgtgtgagtgtatgtgtgtatgtgtgtatatgtataatcctgctctgaagggaagtttatattcactatacatgtgtatattcaaacacatacatacttaatgaatactctagggcttaccagatacatttgaatttatcagaataggttttataattttattagcttaaattttcagtgaatatgaaagtgtttctcctacatagttctatttcattcttcctcttttgtgctattacagtactatatatatatactatatattatattactatatattaatagcatatatagtaatatagttatatattactataatactgtatattaatattttgttatatatgctattatagcatattttattatatgctattatagcatattttattttatgctattatagcatattttattatatgctattatagcatattttattatatgctatgtcatatatagtaatatatatattgctataatagcatataatatatgatattaatatttagtaatatattattaaatatattactcacacacagaggattaaatatattacgcacaaaagaggaagatgaaataaagctatctaggggaaacacttttatactcagtgaaatatatataaatatatatattacatctctatatgtcacaaacccaataatcttatattaatattatcactttctataaatgtttgcctattaaaccaatatgtttatattatcctttgttaatttgtctgttatattatcctttatatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgtgagggcttcaggaagctttcattcatggtgaaagcaaattggcttgtcacatggtgagagagggagcaacaaagagagaagcaaggtgctaggctcttcgtaacaatcagttcttgcatgagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgatttctttacaactttgctcctacctgtcccctttgtgcagctagtatcaaatatattacatttaaatatattatagatccaataagacaattatatatatacatgcatatataaatgcacaacatatgtgtgaatatatatacatacatatatagttttctacaattacttttaaataagttaagagaagatagaagaaaaaataagtatttatatcatcttttataattacaaaattacctttaccaatgctcattattttgggggagtttattcaaattgctgtttgggatcaactactttcaacttgaagaactttaatttttttttgtaagataagtcttttactaacagtttctctcagtttttgtttatctaggagtgcattttgcctttggttttaaaatatatttgcttggatatgatattcttggttgacagtttttgtttttcttttctttttcactgctttgaatatgtcatcttagatgccttttttaggctgagaagattgttttctattctatttgctgaaaagtgtctcaaaatccctttatatttaccagtatatttattatatctgggttcctcattcctttctgtaaaactctttttttatctggtataatttgcattactaagaaacttatagcatttcaaattgttcaggttgttggactcaaaggtttttacattttttctatcagaaaatgtctttaatttcatctttaagtattatttttatttcatacaaaatccaaattgctcttcattttactttgatcactttaaaaacattgttctgttgtcttttgtctccattgttttgggtgagaagtcagttattgttttaatcataattccctgcacttgatatgtcccttttatgtgactgcttcaagatttctttttgtatttgcttttcagcttgataaaatgcatttatcctaatggagcttggcttcttgtattcttaggttgatattttcttcaactttggaaaattcttagccattcattacctcttgaaatatttcctctgctctactctctcttcttggtttctcttgacacatatgttagattgtttgatgttgttccacagataatggacagtgtgtgtgtgtctgtgtgtgtgtgtgtgcacgcacgcatgtgtctgtttatctgcgtgtctgtgtttctgtatggataatggctaatttcctctcttgcttacatagataatttattttgttggattcggtctgtgaataatcccattaaaatacttttgaccttctgctttattgtgttcaggaatttttatttctagcatttggctgcttttaatattgttcacataatattccatgggaatttcctatttgtttatacaagttgtgcatgttttccacttgacatttttacatacttaacatagttatgctaaaaccctatgagatgatttaaacatctagaccatcttaaagtctagctctgttgatttattttttctttcttgacagtgggtcatatttctttgtttgctcatgtgtctgataactttttgctcaattccaaacattgtgtatagaagaacagtgattactaaagtaaatattaattgatgtctgggaaagtgcatgtcattactttagggactgagtcaatcagatttgtagttgagatgatctgagcattgttagattcagtttagcacaggcttcaagtaattcgaatgtatgatcagacctcctacatatctgagtgtctggaggttttcctgtcctgctatcagatttcggcagactcttctacgttggaccccacagagggctctttcagttcccctgcttctgcccagatacctgctgctgataatcagtctaaagcccagagtgctcgggctttttactcagttctccttctcttcccttagacttcaacaggtccaaagcacctgtccctcaaggggaagcagatctctctcagcactcctgccactatctcatgtttgtagtatcggtgccgcagagggaagtcttttttggctcttttgttctgccccaaaactttcttgagtacacatgatgaaggcctatgaaaaataattgtcaaattactatagattctccttgttctttgatctccccacgtttttaaacagccataccagcctatactttgtctgtaaatatctgttagaagttaaactgttttcttcttgctaacatctgtgactacaaccttctttcatcactgttctaccaatgatgaattttagtccattgtgtcttcacaaactcagctctctaatgggctttgaaagatggtggtttatagattatctatgtgttgtttttgttagtgtactagtgaagttctcttgtgactgcatcctaagtggaagtgaaaaatattttctgcaacaaatacagaaataaaaatcatatggtttttatttataatgtgaccactaggaaacaaaggtacaggattaaattcagcttcatgaaggtaaatacttaagatatgaaataaatatgtttcaaagatatcaattttcagtgttccaaagattaaatttagaataatgagatgaagaaatagactatgtacttttaaggcaatctattgtaaattttacttctcttggactgtttttagcagatggacagcagacagcttgatgctgttcctggagttgtacaagatgctcaggtcgttgttagaaaattgtgtttgattctatgctgttgttttcagcggacaaatgatagaatattgttagtgatggtgtgtgtgtatgtaagaagatgttggccagaacatgaagaggcatagtaaccatgctatgagaaatagttaagagaacctggaatagattatgcaacatgaagaaaatatgtttatatttaaatttctgtgttatgtaagactgagttgattattaaaatttttctgcagttaacatctttgcacataaatgtttctctatactttagattatttccctaaaatagatatttgtaaattaaattgttgagtgtaaacagccaaaacccatgagctgtattatataatcgctctgcaataaagtagaaccagtttttattcccatcatcagtatttgagtatctcttctgccatatctttacctagtattagtattatctttttaaaaatgaaaactctctaggtttattgtaggacagtatcctttttttttttttgcctttctgtttcttcagtttttgtagttctcatttcaaacatgaatttctagatttttatgaggctacattcgtatttcccttagagaaggatcaaggattcacaccttctgagatgccagaacacagcttgctttacttttgcttcatggaaatttgcctaacctatggctccttccagagtcctgccaggcgatccatgggttgggtctaggacctgtaacataagactgagtaggtgcgttagaaccagtgagaagcctttaaattctcatttccagtctcaaacagacacctgaatttttatttagaatctctgagtgagtaggtttgttctgcgtacttacaaatatttgggttttagattgaaatgggggacatcaaagattctgcttgtgttcggatcttaaagaaataccaggactcactcaggtaacttgtaaaagtctacaatggaggggcttacattggctggagttattcttgacacaatctgttttttagtcctgaagtcattctggctgtttccaaagctgctcaaacaattaatcagtgtgctctaaaggcagggtaccacgagcatgatttccaggcaactaaaacacaatgaattattggtcttatgatacccatgaggcttgattctcttttcctcaaagaatggtggaaacttctttttattctaagccttagggcctcaaggcatttgtaaatagatctttgaattattgcttacagctggttgctaaactgagtactttggcctaagtactaaagtaagaactaaggtctcctgctttatatctctttgcttaaaatttacactaaaagtaaaacaaatttttaaagaactacccatttaatacacaaagtttagttttttttaaaagagagatgcctctaacaggcattatactgttaagatctgatttttcactgctgagattaactgtattgcctgactcagaactgacccggttaaaaatcaggtctagaacaaggtctgctcctgatccatccccagtatttgcctccattatgcaaagtactttactctctttctggctccaagaataacaaacaggttgcaaggaacttggctgaagaaaaaggacacaaagtctctccgttcctgtttctcttcatttggcttgaggcataaatctgcttccaaagcaaagctgacttctttagggagcaggcctctgctcccaaactgcataggtgattttggaagcagtaaaaaaagaagaaagagaagaagagaaaaggatccaatagttcctaccagggcttaaggaataggaaagaagattgcattaggtacaagtccatttatgaagacatttagggctcacaataaaacatataaaatgtgttttaaaagtaaaaccatgtttttaaaaagcatacaaagcggcagtggaagagataaatgagaatcaactcacaattgaagggaaaggaagaggccttaagaagatagagtagtactatctgctttagacaggacaggacaatttatgggctgaatacatgacaatatagagtcatggagtgatggatattatgtggtggggcaaggtaaaacagtgccctccttctcttacctgcctgattcaaggatggagaagacactaaagtgattgatatagacaaagctatgcttcttgcattgagacactgtccactctaaatagacacaaactttagaatttgtattacatatatattttaagcaaaaatgtattaagtacttctatttgtaaaacatcatgctgggcatactaggccctgaggggtttcaaaacatgaataaaaagtagaagaaatgtatacatggccacaaatgatagctaggaacaagcaagggggagacagaagaagtatattgagtgtgggcctcatgtggacctagccagtcttggagttccatttgtagtgatgatatgggctacttagctcaagataagagctgggaaaatagacagaaagtgttttaaattatgtacttctgatgtggttggggtcagaagtgccaccgagatttgcagaagtgaaagcagcttagagagaagagacacttttaattcttggtacatcttttaaaaatgatagacgttaatcatgtttttgctaaattattcctactacttacatagatggttttattgaggggatattataactatctaccaaaacatgtttgttttagatatttgtattctcgtaggtactgatgttaatataaattatcaagaagaagaataattgggtttgttctaaaaagaagagttgtcaagctattagtaatcctggtgggaatactatttttaaatatttacagcaaattccttccttaataattcagaatgtccattctggaattccatccccttaacttgcacttcgttttccccctttgagagagttttatgcgtctttggaccaaggggttcttcctagggtccacctgcttgaggtcatgactctgagtctggttgcttattcttcctttcttcatctcactcgttaaaatcaaagccttggctcctcagctggaatccagatctagcataaaatgactcctgttgacttttcttgccttacctaccatcattccttcacatatttttggtggtcaactatgatcttctactttatgaaaatgtcttccatttgtttgggatattttcatactggatcctcacactttttatatgcactcaaaatcagtcaatcaactgcagcttctccacacatccacctggttcttctttgtctgtcctagcagatacctgcccttacctgttgacctcccagcttcctggaaaagccccagtgtagccttgactatcataagaacacaatatcctcattctttaaaatgcttccaacatttccatccttaaaacccttaaattgtgctggagttttgggactaggaagcaggggagcaggtcagactgcctcaagcctcctaaaacacttttgtactgtacacccctcaacccctgccaaactcaagaattataaactcacaaatagctccatcagcttctgcctttaaggttcagtattagttttctagggttgccaacaaattaacataaacttgttagcctaaaacaacagaaatttactctctcatagtttggagaccaaaatcaaggtggtggcagggctgcatcctctccaaaggctccattccttgcttctttcagcttctgatggctccacatatcccttggcttgtggctacatcactttcatatctaccttggtggtctcatggccttctgctcttctaggtgtgactcttctctgtgtctttcttttataaagacatttgtcattggatttagagcccacctagaaaatttaggataatcctaccctaagattcttaacacttacaaccttaatttgagggtctgccaagcctttttttttttccatataagataacatttacaggttctggtaatttggacatggacattttttgggtggagaaaggtaccatttaacccaatacagcctgttttctataaggggttaaaatcattgaaaagtgtccagtaaaaaagggctaccttggccgggtatggtggctcacgcctgtaatcccaggactttgggaggccaaggtgggtggatcacgaggtcaggagatcaagaccatcctggctaacacggtgaaatgccgtctctactacaaatacaaaaattagccgggcctggtggcataagcctgtagtcccagctactcgggaggctgaggcaggagaatggcgtgaacccaggaggcagagcttgcagtaagcagagatcacgcaactgcactccagcctgggtgacagagtgagactccgtctcaaaacaaacaaacaaacaaacaaacaaaaaggctaccttactcagcgttatcagttatcacttcactctgtaaacagcccttcacaaaccaaaacttcactttacttctttcaattacctagaaaaatgtccttatgcatgtgaattaaaacaaacagtttccgatttggtgtgagggaggagtgaaagaggagataaagaggtagaaatccttaatgaatcttaataaatcaaaacagaggcgaaggtaaagggaaaattttaatcagaaagtcaaaaatatatgtcaaatctacagaacaaatccataacaaaataagaaattagatggcaaaagtagtgtctagcagagttaaaattatggcagggtgagatgggacagtctgagccatgcgagaatttgtccaaaagtagaaactggaccctggggtgcttagcatttattgtgttgatggacacgtcatctttaaaaattatgtattcatggtctacattgccagataaaacttccctaaatgataagatattgcgtcatagacaagcctacaggtacaggtatttatatggataggttgattattaaaaactcgtggaaatatttgaggcaagcttataataatgcacagatctaccttggttgcatgttttattatacctcaattaaataagcaagctaagatcacattccacccataatttatcatctaatctatattagtatctagtagcatgaattctgagggatacttaacaaatcttaataaaattattatgacatttattatcacttgtccaaatgatttgagtataaatctataaaaccaagtaaaaaggatataaacattaaccttttctacctagttataaatcgtttgctagccatagactatatcagtggcaatacataaaattttgctgctccaattgtacctttatctcaggaaatctttttagattgcaccttcagaatacagctccttgctattcaaggtgcagctcatggactagcaccaagcctggaggcttgttagacatgcagaattgcagactccctgcctcaaacttacttacataggtgattcatatgcatatcactctttgtaagtttattatatattaaacctcttctcttactcccttgaatttaacattttgtcattcctagttgtagtttttacttcaactcagtgtaatatataccattctccctgaaatagtaaaataaaaagggaagttataaaagtgataagttaatcaacctgtattctctatttactatttattttattcagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctggtatgtatatacaagaaacttgaaattttaaaagatttctaaatacagtgccactttcatatatggttgaatgtatttgaaaataatgctctgaggtaagtgattcatctgaaaagcatgtgtgtgtatttcactatcaagacagtcaaaaatcaaaagaggaaatatgaagtttaagaatattttaagacagtcaaaaatcaaaagaggaaatatgaagtttaagaatatattaattaagaattaatatagaggaagaggtgaataggaactactgaaatgccactggagaccattggaatgacgtaagtatttagattataaactttaatgtaaattctgaatcttaactaggcagactcttgcttgattaaacatgtttcatgatttagaaggttcataattctgtgtctctctcgaactcatttataactgaatggccaagtcggtggatattttatggtaaataccaactgcaattaaatagtgccaaaattttaggtttgatattacttggaaataattttttcctaacatttaaggataagtagacatcatggtaaatattcttcagagttacatgcgaaccactgatagtgagcatatcacttctagatatgatcttaagtattcagagtccagagtgttcaccattaccccgtggaaccagctctagatatgatcttaagtataaattatattcagacatttaggtatgaaagaattagattgaatctctccgagacattgtttttgttattattattcttaaaaaatatttaatgttgtcacttctactttgagattaaaaaataatttaagacagatcttatggtaatcatgtctagatgatgagcctatatattgtaaagaaatcattttctgagataaataatacagataatatttgcaacaaaattccaagaaagaaggagggaggcctacatctattatcagtgtcaaagaaagtatcctttctctctgacgatttttacttcaaagaatggtgttcagctaagacttaggtcatattgtattagtcaagaaatcacagaaaattaattaaactccatgattaaaggtctgtatttgagataggtaagtaaaaatattttacctgagatgtttgtttagaccaatttaatcacttagtatttttctgcaattttagtgaatgcttgttaaatcaaatcaaatacatgatctgtcagtataaaattacataggtaaaccaccagtggaatcatgccacagtttctttatatttttgtttttaaagaaagagcaacagtgttcggtccataatacagaagcctctattacaaacatatgcagctctagggaataataataaaaaccaaacacaagaatcctggctatgtggtatctgtctcctataaagcttcatcttagattacctacatatcctgatgaaatttctgtgaggtagagaaaagcaaacactagtgttcattttgtaggtggatatgctaacacaaaaaatttagtgtttaggtcatatctagtatcatagttaaggttgaaatctaagtttctattagaactctaataaagattcatataaatagatgtgtttctagaatcctgcttgagaagccgactttgagaaaactcaatgtatgagaacagctgtcagatctaaatttgaattctgaatcttgcaattagtcatattaacttagataaactatttagtgtctctgagtttattgcccattaatgaacatgagcataggactacctatgtcaaaatgttattatgaggattaaatgaaatggatgtgaaaatattgaacatagaccaagtattttagtgctttggccccttaatttcagaattatccttttttatctaataaattacattaaattacatgaaactttaagagatagtttacttatagcagtccctgtttaaagacattagaactcataactatatttagaagttaggccaaggaactgaggtaaacagaaatgtagagaagtgatattaagagatcacagtagcattttaatggaactctgccattcatttaaaatcttctctacaccatctaaaacactgaagtttggcaagtcctagtcaaatgagctcagagaggctacattttttttttgatatagggaataataaaagaagagctatcattagaatcagaacaacatttttccttagtgatataggggagaaggaaaaaataatagagtatttcctgctctaaaggcacagttgttactttaaaccaacttatttttgtcatcaccttctttaggcatcacctcttacattttctcaaatggtattttgttaaggacttagttccccatctgatgtgcttacaaaataacttcccttacaagccattagagccaaggccaaaagcaaacacacctattcacagagtaagatacaaccttgtagtgatatgagatgattcattcttctcaattgtaaaaaaaaaattaattctgtaacttctaacacatttgttaatctatcatcagaaaatattttgagatctttgattaataaactcattactatagtttacacatttgcagtatattgtcagacacagtgcttagttctctgtttgcattgcttaagttaattcccacaataactttatgaaacagatgaggaagttaagattacacccagctaatgtgaggcagagctgggattcaaatctaggtgtttctcatctaaaggctttgctcctaaaccactttctgaagacagtgggcagtattgtggctccgggccactgatcctttggtggaatgcccgcattattatctaaaagctatgtaatttgaggcacattacttaacctctgagcctcacttttttttttttttagacagttcagtggctctttttttggagtgcagtggcacaatcacagctcactgcagcctcgacctccaggtctcaagctaccctactgcctcagccatcctagtagctcggattacaggggcttgtcaccacgcccagctattttgtgtgttttttggtagagactgggtttctccatgttgcccagctgatcttgaactcctgggctgatgcaatccacccaccttggcctcccaaagtgttgggattacaggcatgagccaccgggtctggcctgagtctcacttttttcatttctaaatgggaatcatttatcttaagggatgatttttatgtttacaaacatattaggaaagcagttagcactgcactgcatagtatttgctcaataaaatttatttattatgctattaaatgtcctttaaaaatttaatatgcttacaagaaaatatggtctcctgtctactttgtaatggattacccatttagcaatacatttccaatttttataagcatagaagaaagatcatataattttatgtaattttcaataatcttttaaaagtcattttatgtatttgatataaaattctacagaatttctctactgttttgccatttacttgctttattaaaattgaatatgcatcaaattggacatttacatttttcatttttataagaaaataaaaatactttctaaatgagggatgtttgtcttgtcgtgtaccattataacaactctctaagagatgccagcatatgctatgtgggacaaaggctggttcccatttgatggaaaggttggtccccagcctcattatgctgattgaaagacatgacattatccaatgccacacatgcccttatctgtccaattacttaatgttaagatctcagcgcacacttgggtgcattctttggattcagacacgtgcattataaaatggatgctcccaaatgaaaaattagaagatgtatttgtaattcattttaacccatttaattttgactgtagaaaagagataacaaaagtaccctttgaaataatgtgtcattgtaagacatgcccccatggctaatagctctgcaggttcagttggtgagtccacatcctaaaatggtacattcaggtttgttttaacagctttctttattagccagatcaagccagtcaaagaaaggaaagagaaaaaagaataaaaccaggaacaacactttcatattatgtataaagccttgatttcatgcctaatgaaggtctgttgttctttcatttagtattctttctcattctttcttttttctttctctttttcacacatatttgataaaagagaagaatagaactaagaaaatattttatagctggtaaggtactatgtgatgttagttgctgtcattaatacttaaatagataaatctttaaaagaagcaaagaggatagatttttaagccatctgaagacctgaattaaagatggcagcttctccacatgtaagcagtataatctgggcaagttaattagtgtattcgggacacatttgcctttcctattaagagaggggataatgccaattctccatgatgctgatctgggtatccaattagatgaagtatatgaaaataacttctaagttctagatgtgtgtattattaagctgagatcattcattcagcaaacttttatatttaacatatcgaattaaaactagttgtacatatttattttttaccactatgagaaaatcatatccagtactggaatctgattttattcatattgttatctttagtgcttcacacaacacaatgtccatagttggtactcaaaaatatttgtagaagataaaaaggagaaaccaggagggtaagatgatgattggggctattggaagttaattgaggatgatgaaaaaaaaaggagtgatcaaggcaacaatagatttgcatattataatttagaagaatctattgccaaatacattgtgttttgatgattgaaaacaagtttaacatatacattcgatgctattgtccatatactgatgaaagaagaaagcggtcattttttaacttaatttaaacaaatagtctgtaactggtttggattcttcataagaattttactgtggataattataattttaatgtaaagaattcttttctgcccatccaaacattttccccaactgacttattcttagattatcatttcattgtgcaactaaaaactcattctgcttcacctatttaaatttcttgtttgaaaacaaggcctataacaataaacaaacctacaatttctatctgatgagacataactatctgtgaccctctatctttttaagctacaatgggaacatcattttaacatggtggattatattaggggtgttagcaatccactcctctatcagagcaagcgctcagaagagttgcaaagaactattctcattttaatattaaaatattatatagttcatttgatttttttgatagctcttcagaattatatacttaagtgcttaaagtataataaaaaagaatgtatgtataaatatagaattaatgcaggtgttagacttcagtccttttggttttccaaactagagcactatttacataaccatgttgaatctcttactaaaaaaattgtattaaatcaccatgaaattccaatgcaagttaaagtaaaaagttacattcatgattaacttttcatctgtaaaaatgactgtataagttaaagttataattaacaagaattaaagtagtcaatatgttttcaatcaagagcttatcttcatatactttataatttttataatttaggatttgtcacaagccaatttgtacattcttaaataaaacatcaaagcccaaagagatacttatatgcaaattatttaagcattcagatctgaaaggaaaattggcagcattaatttcttttcatgggaaagaatagtcatggcattggcttgattttctttaaaaaaaatttttagatctatgactgaaatacagaagcactcttataagcatcataagggaattactattaaatagaaattaagacaaaaggacaagttaaagcagctcactatttttaaccgttcacagtaaaattatacatgttattaataaatgattaataattcaataatttttctgaatagtttaaattctttttaatgatttattgtgtaaagaatgtctagtttgtttcctgttaagtgcactggagcctaaacttaagcttccttgtacttagggtgatttacttccctgaaacaaatcatgctttggccaagtccccatttctgcagggctgagtgcaaatagagcacctaactcctctattctcagattcatgttaaatatgtaggttttgtgtcaattccacctgtgaaaaactttttctaatatgctaaggctacaattgaacattcaaagctaaatgagagaaattaaatcaataatccaagtaagatataaaaacactttattaagagaagcagttactgttcttctgtgctttttttttttttttttttttttgagacagcatcttgctctgtcgcccaggctggagtgcagtggcaggatctcggctcacagcaagctctgcctcccaggttcacgccattctcctgcctcagccttccaagtagctgggactacaggcgctcaccaccacgcccagctagttttgtttttgtatttttagtagagatggggtttcactgtgttagccagggtggtcttgatctcctgacctcgtgatccgcccgcctcagcctcccaaagtgctagattacagatgtgagctaccatgtccggcctattctgtgcttttgtttatgtcccattttccatggactgagctcagtgaatgatctctgaagagcaaatcagtcttgaaaatatattacaaagtgcttaaaagaaacatgataaaatggaaagagatattcaatctaatttaaacatactccatttttaggtctgttccaaataaaaaggctaatattgcttataatgaaaaacatttcagtaaaatgctttaacaaataatacttgtcctaaggaaggcaatatttgattcaacaaattgcagtataatattttagagttatttttgaaattatttgcctgtgactactatacttgtacttaaacacccttattgtttgattataggacaacttactttttgttttcctatagcatgaaaagttttaacttcagaatatgagttataggggtaaaagagttcctagaagttattttaatactccagctcttaatatatattatatctaaagtgctacaaattattttttaaccctgtgtagtcagtttcattttctaacagtcatgtaatcacagttgaatagtaaaataaaatctctcaaacttcatattattaataatttctctatggggaaacaaaataatcatatagttttattttttttaattttaagttaagaggtacatgtgcaggtttattatataatgtaaacttctgtcatgggggttagttgtacagattattttgttaactaggtattaagcatagtacccattagttgtttttcctgattctctcccaacttccaccctctactcttcaatatgccccagtatgtgttgttcccttttatgtgtccaggtgttctcatcatttagcctccacttataagtgagagcatgcagtatttggttttctgttcttgcactaatttgctaaggataatgacttcctgctccatccatgtccctgcaaagtacatggtcttgttcttttttatggctgcatagtattccatggtgtatatgtaccacattttctttatgcagtctatcactgatgggcatttaggctgattccatgtcattgctattgtgaatagtgctgcaatgaatactcatgcatgggtctttagaatagagcaatttgtattcttttgggtatatactcagtaattggattgctaggtcgaatagtatttatgttttcaggtctttcaggaactgacacactgtcttccacaatagtgtataagtgttccctttttctccacaactttgccagcatctgttattttttgactttttaataatatccattctgactaatgtgagatagtatctcattatggttttgatttgcctttctctaatgatcattatgtggagcttttttcatatgattgttggccatatgtgtgtcttcttttgaaaagtgtctattcatgacctttgcccactttttaatggggttgttttttcttgtaaatttaaattctttatagctgctggatattaattagacttttgtcagatgattagtttgcaaaatttttttcccattctctaggttgtctgttcactctgttgtagtttcctttgctgtgcagaagctctttagtttaattagatctaatttgccaatttttgctattgttacaattgcttttggcatcttcatcatgaaatctttgcccattcctatcttctgaaatctttgcccattcctatgtcctgactggtattgcctaagttgtcctccagggtttttatagtttgagattttacatttatgtcttcaattcatcttgagttcattttcatatatggtgtaaggaaggggtccaatttcaatcttctgcatatggcttgccagttatcccaacaccatttattgaatacggtgtcctatccccatttcttgtttttgtcagctttttcaaaaatcagatagctgtaagtgtgtgaccttatttctgggttctctattctgtttcattggtctatgtgtctgtttttatgtaccagtaccatgttttttttgattaccgtagccctgtagaataaagttgggcagtgtgatgcctccagctttgtcctttttacttagggtttgctttggctatttgggcttttattttattttatttttttggttccatgtgaattttaaaagagtcttttctagttctgtgaagaatctcaatggtaatttaataggaatagcattgaatctataaattgctttgggcagtatggccatttttatagtattgatgctttctatccacgagcatggaatgtttttccatttgtttgtatcatctctgatttgtttgagcagtggtttgtagttctccttgtagagatattcatctccctagttgtctgcattcctaggtattttattctttttgtggaaattataaattggattgcattcctcatttggttcttggcatgactgttgttggtgtataggaatgctagagattttcccacattgattttgtatcttgagactttgctgaagttgtttatcagcttaagaagcttttgggctgagactatagggtttctttctttttttttttttttttgagatggagtcttgctctgttgcccaggctggagtgcagtggtgcaatctccgctcactgcaacctctgcctcccggtttaacgccattctcctgcctcggcctcctgagtagctgggaccacaggtgcctaccaccacgctcggctaattctttgtatttttagtagagatggggtttcaccatgttagccagtgtggtctcgatctcctgacctcgtgatccgcctgcctcggcctcccaaagtgctgggattacaggcatgagctgctgcacctggctatgggttttctacatataggatcatgtcatctgcaaactgatatggcttgacatcctctcttcctatgtgtatgtcctttatttctcttgcctgattgccctggctaggacttccaatactgtgttgaccaggagaagtgagagatggtatcctggtcttgtgccagttttcaaggtgaatgattccagcttttgcccattcagtatgatgttggctccgggtttgtcacagatagctgctattattttgaggtatgttccttcaatacctagtatattgacagtttttacatgacggggtgttgaattttatcaaaagccttttctgtatctattgatttaatcatgtggtttttgtctttaattctgtttatgtgatgaatcacatttactgatttgcatatgttaaacaagccttgcttcccagagataaagtctacttgattgccatggatgagctttttgatgtgctgctggatttggtttgccagttatttttttttgaggattttttcgttgatgttcatcaaggatattggcctgaaggtttcttttttgttgtatttctgcctggttttggtatcaggatgatgctagtctcatagaatgagttaaggtggagtccctcctcctcaatttttcggaatagtttcagcaggaatggtaccagctcttctttgtacatttggtagaattcagctgtgaatctatctggtcctgggcttttttttttttggttagttggctatttattactaactcaattttagagctcattattggtctgttcagggattcaatttcttccttgtttagtcttgggagagggtatgtatccaggaatttatccacttcttcaagattttctagtttatgtgtatagaggtgttcataatatcctctggtggtttcttatatttccgtggggtaagtggtaatatccctccttgtcatttctgattgtgtttatttgaatcctctctcttttcttcattagtctagttagcagtctattttatttttttccaaagcaccagctcctagatttgttaatcttttgaatgaaattttgtgtctcaaacttcttcagttgagctgtgactttggttacttcttgtcttctgctagctttaggatttgtttgctctttgttctctagtttttttagttgtgattttaggtttttaacttgagatctttctaactttttgattgggcatttagtgctatgaattttcctcttaacactgcattagctgtgtcccagagattctggtatgttgtatctttgttttcattaattttaaatatcttctcgatttctgctttaattttattatttacccaaatatcattcaggagcagttattcaattttcatgtgattgtatggtgttgagtgaatttcattcttgatttctaatttgattttgctgtggtccaagagattgtttcttattatttcatttcttttgcattttctgaggagtgttttatttccaattatgtgctcaattcttgagcatgtgccatgtggcaatgagaagaatatatattctgttattttggggtggagagttctgtaggtatctatcaggtccatttgatccaatgctgagttcaggtcctgattatctttgttaattttccatcttgatgatctgtctaatattgtcagtgaggtgttaaagactcattattatgtgggagtctgagtctctttaaagctctctaagaatttgctttatgaatctgggtgctcctgtcttaggtgtatacatatttattatagttagattttcttgttgaattgaaccctttaccattatgtaattcccttgactttttttatctttattggttaaaagtctgttttgtcagaaactaggattgcaaaccctactttttactgttttccatttgcttggtggatttttcttcatcactttattttgaggctatgagtgtcattgcatgtgagatggatctcttgaagacaacataccaatgggtcttggttctttatccagcttgccactttgtgtgttttaattggggcatttagtcatttacatttaaggtaactgttgatatgtgtggattttacactgtcattatgacgttagctggttattttgcagacttgtttatgtggttgctttatagtgtcactggtctgtgtaattcagtgtgtttttgtggtgtctggtgctggtctttcctttccatatctagtgattccttcaggagctctggtaaggcaggtctggtggtaataaattccttcagtgtttgcttatctgaaaaggatcttatttctccttggcttatgaagcttagtttggctagatatagaattctggtttggaatttcttttctgtaagaatgttgaatattggccccaaatctcttctggcttgtagggcttctgctgaaaggtccatttttagtctgattggcttcctttgtagttgatctgacctttctctctagctgtctttagcattttttctttcatttcaatctttaaaaatatgatgattatgtgtcttggggatgatcttcttgtgaagtaccttactgtggttctctgcattttctgagtttgaatattggcctcactagttaggttggggaagttctcctggatgatatcctgaaatatggtttccaagttagttccattcttcccatcttcttttccagggacaccaatgagttgcagattcagtcacatattttttgaatttttttcatttctttttattcttttttctctattcctgtctgactgtcttatttcagaaagccagtcttcaagctctgagattatttcctctgcttggtctattctgctgttgatacttgtgattgcattatgaaattcttgtagtgtgtcttttagctctatcaggttggttacattcttttctaaactgtctattttttctgtcagttccttcattgttttataattatttttagcttccttaccttgggttacagtatactgctctagctcagtaatcttcattcctgtggataatctgaattctatttctgtgaatccagccatctgagcccagttcagaacctttgctggagaggtgattccatcatttggaggaaacaaggcactctggctttttcaattttaagccttctcagaggattctttttcatctttgtgggcttatctacctttaagctttgaaattgacaacctttgattttttttctcttttatcctatttgatgaccttgagggtttgattgtggtataaggtagattcagtagactagcttctgcaagattttatggggccaacattcacctcccaattcctggactgcatgctataactctgggggactcatattaggccctgactttgtcctctggctcctcaaggtttggaatccactgcactggaagggagggctaaggtgtagcagctgtagcagagtgctaacaagtgctggggtatctgcctccctgcaggtgttcaccacagtggcagaggcaacacagctggcaggcaggagcagaggacccctgctggagactgtgtgtgggcatgctggaggtggtattagctcaggggctgggtactggtgggaaaagtctggatgtcttctctgtgtcccctaagcaggtgtgatccaccatatagttctgcatatagttttatttgtttctgtgcaattaatgtacatacttcaccaaagaatttacatagctaatatcagaagttttcatgtaggtatctttgaatcacaattattaggagctacaattcagtaaaaggataccttgctttcagcactctaaggaagatgtggctattccaaaatgggagggcatttggggactaatatttcatctctttgaaatgttaacagatttgaggatggtatgtcagactgagtcaaagcatttgcatgggaaaaggtatgtcctctatagaaacatggacttcatccagatggctgggtagctgggtggtgcccagattgcaggaacaaacaatgaatactttgttcatctgtacaaggccagttaggtgctaagcatacaaatccaataaggtacagtgcttacctgaaggagtttgaaggagagagaaaaacttggagagaatcaatgaagaggccattggacttggcagttaaaagcagttttgtgtggttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtcttgatctcctgaccttgtgatccgcccgcctcggcctcccaaagtgctgggattacaggcgtgagccaccgcgcccggccagttttgtgtgtttttaaagagaaatttcagttatttaaagaaatggatatgaagcagctatatcacctggggtatataccctggggtttgtcatcttgcaccaggaaaacttaggacatggactcacacgaggagtttagcagcagaggtttaataggcagaagagaagtgaaagagaaacagttctctctctatagagagaggggtccctcagtggaaaagactggctgtcagtgaatgtgccaaattttatagtcaggtttgaggaggcggtgcctgatttacatagggctcacagattggtttgatcaggtatgacgttcacacaatgcatgcggaaggtggttgtcccactctaatgttagcatgcaaatgggctttccagttgactggtgccatcttctctgcttctcactgtacacttggccgacaaagggaagagaagatggaccatcttgaacatgtatagtccttacttcctgccagcattcacccatgcaagctcccagcttgcttgtttatgtctgcagctcaactttacaggctgctctttgttagaaaatgatttgtggctgcctttcaataaaaagcaaagccttaccaaggactctcattcagttactttctgcctaagtgatttcttaacttctatatcgttcccccctctggagtggtaaccctaattgctgttagtggtcatttgaatgatgactctttctggcaacttcctcctataaaggggcattgtgtggggaacagcagctatggctcctcctggggtcaatctaagggtccttggaagaaaggcatgtccatgtatggttctgtctgcagcaccatttggagtttgattgtttctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctaggtcatcttttttaacttgcaatatgattgggagaaatatgtcattgggtggctagtgtaattttagtgttaaccctagctaaatctttcctgcaattaattccttcacagcttccaccaactatctatgacatgcttaaactttctggcttgtcctaaacatccttctttttaaacaaccaactattctttttaggacatgtatttaccatccttctaatcctttcatgacttccatgaaccatctatgacatgcttaaaccttctgacttgtcctaaacatctctcttttaaacaactagctattttctttaggacaagtatttctcatacaagatcccttcttatataaaatctctttcctttataaccttctttgcaccaaacggtagcatgagcatggagaactaaaaaagcatacttggagtcagtgtaaatgttagctacctttaccttgcttaactcaagtgctcttgtaagagctatcagttcagctggttgagcacttatgcctggagtgagagacacactttcaataacattcagagtgactactgcatatcctgccttctgtactccttgctctgtaaaggagcctctgtccatgaagagggcccaatctggattttctaggggagtttccctgagatcttccctggccgcataggtctgtaccacaacttgttcacagtcatattcaggtcctccagttcccttggggagaaaggtgactgggcttaagcaaaaacaagtttttaactggatggtggaaccctctgatagtagggcttgatatttaaggagcctgctgtctgttaaccaaaggctttccttagaggacagtaatcccaccacattatatggggtataaatagtcatgtcatttcccaggattaatttggaggcttctgggaccagtagagccactgcagcaatggatcaggggcatgctggcaatcctttaaccatcaaattaagttccttactcaggtaacccactggctgttgagctggtccacagacctgtgttaaaactcccaaggtcatttccttcctttctgatacatacagattgaaggcccttcctatggaaaggctgtgactatggcctcagtgagatggaagtcctgaagtagtcttcattccccattgagttttatgtgctcctaacattggggtgttgaatgggctgcttcaggttttgaagaggccctgcatcatcaggttattagtaatggcttctagccctttcctagcctctggcttcagtggatattgtttctggttaggaaaagaagtgggatccttaagatggatctggactggcctagcagttacagctcaactcattgttccttcagttgcccacacttctggattgatattagcttctaccagggggtgacagagtttgtcctggggctataaggatgctggtctgcctgcaagtaaaatatctctacctaataaaggagtggaactttttggcatgattaaaaaagcatgtgtcaataataggtttccccatctgcaacctaaggggttgtgaaaaatattgaattagactttttcctgagatgccctgtgatgcctggtcatgctacagaaagaggggaggcctggattagagaggagaagagagagagagactggctctagtgttcacaaggagatctaccttccttcaatttccagaatcacccagggctcctgtgctgtatgttggtttgagccactggagctccgggacccatcaatcctgttggacaatctgtgagactggtttggaacccggtgaccttcatctctgggggcagtccgacttccaatggttccttccacaggctagacaaggttaaggtggttttttcttgctgcctgggcactctttcttaaagtgccctgacttgctgcacctatagaaactagcagatgtacctcagggatcctgggctttgtatgtttgcagagcagctattagtgcctctgtccttctcttttgcttcctctctttctcctggatctcctcctcctggtccctattataaaacaccaaagtggtcacccttaggaggttctccaagatgctatctggtgctatagcctccttctgtattttccttctaatattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaatagattttgcccttgctcttcataggccctccaatatgtgcattaaatggtgtttccttttccatccatctgtggcatcaccggtgttccaactagggtttgtttttttttttagaggaactgcttcccttcctatcgggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcatcagaaaattggcctaaatcttcctttatttgcctaagattctgtaatgagatgggaacttgaggtgaccccaaataacggggattctcagatggctcctctggaagttgcttttctagtcttagggaatcattccctttgggcctgcctgatatgattgctacacttgcaaaggtctagtaagaaggccatgcccttgtgcaaaagaaaatgagccattttttcttcaaagtctcaggatcaaaggagtccctgtgcttcagaatgcactccagaggagtacaggccttagatgataaagagaaggaaaaaaaggcatccctttagtctccttccttttgatgtgacccagggtgggagaaagacagtgggggtgtccccctgttgttttctctccatggttcctggcatcctggcaccttgttaaatgtgctgcccatggttgcaggtgtggcttccccagccatggaaccagaggaactaagtggtgggttttagtcaccctcacccatgcaactctagtcctctgcctagactttggggctctctgaaaaatggatcttgggaaagactatgtaacagttgcatttgggcaattgttgcactcgcctccttaatggaggaagcgtgctggtttgagctctatatcctgctattatggcccatgctaaagtgtttacccttagagaatcattccagttaacttctgacttaaaatccccttactaattaagtaccattctaattggaggcagaataggtatcttaaaagaatgtagggaccaaatggccattttcctgaaggaaggacagtattaagactaaaatttggttttggaggacattttactcctaattgctgaaggcagagttttcccattcacagaaacagcataaagcctggtttctagtagagaggcgtaaaaaggggagagaattgggaagctagagtgcttgggtaaaggagaggattcctattccactaggtggtgctgctgactttgagatgccatgtgctctccagaccaagggcagagtgaccttgacatgccatgtgctctccagatcaagggcagagagagagagacctggaaatgccatgtgctctctagaacaagggcagggagagatgctcactgggggtaccctctgtttctagaacatcacaaaaacaccttcccttgagctatatgcccatttactatgacattatctgatcttgccaaacaggattccttccctgaaccataaatcttcccacacattgcatacacagagaggataagagttatgacagttgccaacaggaaagaaagaaattatgataggaaagttggagatcttgtggccgatagcccatcagtggggacagaggctggggtcagtccagtagcctttggataacaccagggatagccccagccagaaatcctcagttgctccaggactccttccagccccacatgacggctgagtactccatgaaaggaagctggttcaaacatggccaatatgccaagcaacccatgggttctccatgttctccccagtaagcctgtcccccaagtcttatatggctggcagccacgctaattattttatggctgaagggggtccagtatttggtttgatttggttcttaaatggaggccaatagcctctgaatgaaaggacagagttggagtctgctcctctactcattgtttcaattaatgttgtacgctggtatcatggatgaggtccccagtatgaaatggctatgttgtctggggtatataccctgggattcatcatctcacaccaggaaaacttaggacatggatacacacaaggagtttaggagtggagatttaataggcagaagagaagtgaaagagaaacagctctctttctgtagagggagaggggtccccgagcagaaaagactggctggcgttgaatgcgctggattttatagtcaggtttgaggaggtggtgtctgatttacatagggctcacagattggtttgatcaggtatgatgtttacatagtgcgtggggaaggttggtcactgtaccctaatcttattatgcaaataggctttccagttgatcagtgacatcttgtctgcttcttactgtacatgtggctgagaaagaaaagggaagatggagccgccatcttgaacatgtgtagtccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgtgggttgttaaaaagtgattatggagtgaagtacaaaaaaaaaaatagccatatatcagttcttccatgcagtacagtggcagaaaaggatgtgatggcttagggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataatatttctagatatttggggaaacattatccaatacaaatgcatggtttcttaacatttatttgtagaatgaagcatgaaactaacacaacattaagttgttagaagttcataggcttcaaaagtaaaagtggcaaaatctttttccaacagtctatgtaatctttcaaaatcatactaactgaaaggacaggaaatgggcacacttcctatggcaccaaatcaatttttatcttggcagaaaaactgattattacagctactgtgagccattgttattataattgagtggatcatttgtccagtatgtttttcctagtaaaagaaaaacatttgtggtttctgtggtgaataagaattctaacaccaggaaaaaaatgcaggccctctttttgttgttgttttgcatatatttgtttgtttgtttcagcaccaaatgtggctccttcagatgtaggaggtggaggtggaagaaacagagagctgaccataacatgggcggtaagtattgatgagttgcacatattataggttgctgtatctatatttaacttccaccccattttgtttcctgaaataaattgagatgaaagtgactgcctactgcacaagcaagaatatattactatttttttttcttaaatgcaaatcagattttatctggcttactgtggcttagtgtgtagctcctatgcaagaatgaatcctggatgctaagagatctgttagcctagatgattaaacattcagctgtctgattccagagatactttgatcattgtagtctggtaatctaattgtaattttaaacattgtctctggacattctaaattccaaagattccatttacaaactttgtatcaaaacccatttttaaattggagactgcctcctcacttgaagcttactttgatcactggtgtaatctagcatgataggtcagtcttagaagtcacccatgggactagttactgaggtatccaaagcattttattacagtttcgtgagtcaaagagttctgtatcagagactacaatctctagaaaacaatacatcttggctggatttttgaaataggaaagatattgggaggggtgggaaaagttgtctgacaaaactgtctgacttagacatctggcatttatccagataacatggtttatacagattcatttattcattaaatacacttagtgttgaatcactgcagatagtcaaagagcacaatttaggctccaaaggattttgaagactgtggaaaaaatgacaggttttattctttgcattggtcaaatggatttatttaataaatgaatgtttagcaaaacttgactcactgtgtgctttgtagtcattttctatacttagcatttaaatcacattttaaagcaagatttagcaaaaaaaaactaatctgaatcgtaaaatatttatttctaagtttaactgccaatgaaatgtccaaaaatgcaaatattataaaaattagaacatttcgctctttctcttatggctttttataaattctgtggatatctgctacagaataagatgggccttataaaaaattcagtattggaaattctcctccaaagattcaaattcaggtttctggagatagagcccgagagttgttatttttgaaattttcatagctgattctgttatactctaaattccaaaaactaagtagagaactatcaataagaaaaatgtttaaactattgtagaaatgttaggctatactatctaataatctaaaatcacatacctattaatatattgtgcaaccacatacagcttctaccatttgacctttccacatttctatatcttcctatttaatataagtatgtccaagcaatagtgttatatttacttcaaggttttgcctcaagacatcttaaatttgattttctggtaaaaaaaaaaaaaagtaaatatacaatgtgcacatttacctaaattgccaaaaaaggctaactgacaagtactcactagaagtagctgtaagtcagtttttattaataataggtgattagggctgacatagacttctttataaggcaatttacatgagtgacaagaaaccttgagaaaatgatgaaaaaccaagcacttgctttagaattggagatagaaacccaaagccatcctcctacaaatgagtgcaatattgtcccttcctccttgtcacctacttttattcctcttaccagtttcttttcgatcacaaggtagatattctaggctagagtcttatataactctcttaccattgcctttcaattctaatgaaattcatttgctcatccctttaatacatattacttgaagccctgttctaggtgctagggataaagaggaaaacaaaactgacaaaaacgctgcattcataaaacgtgtattctagtagttgagagagacaataaagtagataaataagtaaactgtatagactttgttagggttaaagaaaaacaataggtagggtgcgggacatggagcattgtgttggagtcttgcagtggcagaacctgtggtcggagaaaacgtcgaggtgattttacctcgggaaagtgagggggtgggaggagtcacataacatctaggagaacattctaggcagaagaaactgaaaggaaaaaggcccggagtgagaggcccctgaggtgttctaggagtagtgaggctacaatttggtaaataagatcatcccatgtttaagtatgtttttcctctgacatttggaaccagcactaatgtatgaactgtgtatgtttttacaaagagcacgcctccgtgtgtgtcattatccccatagcatttcctccctgttacctgtattactaaaacctactcaatcttttaatttctatttagcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacggtaggtgaaagaaagaccttcttacctgaggagggaggaaaaacgtatttctctagcaggcatttagtttgtttcctttcaggccttacttattaagacctttttatagcattatgcatttagtaaatgagtactattttgaaccaaattaaacatcaccctcttcatctaaatgatgagaatgttgctagagtctttttcatcatttagatcatgcccatggtatgaggaaatccccattaaaataattggctctgacttccatttttgggctcttgattataattttgtagtcagaaactctccatacttgaacagaatctcaacatgtctgtatattcataaagtttataatttaaaacttctataatatggccgggcgtggtggcgcatgcctgtaatcccagcactttgggaggcggaggcaggcagatctgtctggaggacagagcaagactccgtctcaaaaaaaaaaaaaaaaaaatttctgtaatgtatatattatatatattatttgtaaaatggccccaaattctaacctaaaaatgtgtttaattgcagcatttacgtaactttttattacaatacagaacacaaattttgttaaagggaatctagacataattatatgaaaaagaggtcagttgaaattgttttcttgaaaagggaaaaatttgtcctgtagggcatttaggaaaaaaacaatgctaataccagctctttttgtttttctagaaactttaacttaactaaccatggtcatagaagactttatatatttatacaaatgatacacagttttagattgagcataattacattattttctctgatttctgtttaagctgctatacttttgttatttatattcttgttaaaaataatacctttctggcctggcatggtggctcacgcctgtaatcccagcacttagggaggctgaggcaggtggatcacctgaggttgggagttcgagaccagtgtgaccaacatggagaaaccctgtctctactaaaactacaaaatgagccaggattggtggcacatgcctgtaatgccagctacttgggaggctgaggcaggagaatcgcctggacccgggaggtgaagttgccgtgagccgagatcaggccattgcactccagcctgggcaacaaaagcgaaagtccatctcaaaaaaaaaaaataataataataataatagctttctttattcatgtgcactgtgtaaataattaatgactagaaaaacaaatagagatgtcattgccttctgatctttggcaatgtacatttacccttggccaagtttctctttgcacatgtgtgagaagcacaaatagaagagcttgaaaactaaaggtgtgtgaggtactcttctatcattagaggaaatgggctctattggttcacccaacttccattgttttcactccaagatagacatttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgttaaagtatatatgtgtgtatatataagtatatatgtatatatttaaagttatatatatactttttactatattttttactgcatacaaaagtatgtgtattttaatatatgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtggtggctcatgcctataatcccagcactttgggaggtcgaggtgggcggatcacctgaagtcaggagttcgagactagcctgaccaacatggagaaaccctatctctactaaaaatacaaaattagccaggtgttgtggcacaagcctgtaatctcagctactcaggaggctgaggcaggagaatcacttgaacctgggaggtggaggttgtggtgaaccgagatcgcgccattgcactccagcctgggcaacaagagcgaaactccatctcaaaaacaaaacaaaacaacaatgaaatatgataacttcactcagttttaataatttgaagaacgagtacatcttacagataaaatgagtgtcttaagcattttacaagttaccttctcacctttttactgctttacttgatgctaaaataagttttcaggcaaatagcttgtcatctatttagtcatggctatttgtatttaattatatttctttcctaaatatttcatgagtctcataaaacttgcatgtgttgaaacttgtataagtgttaatctcttcttccactgctgagaaatcaatcatagtgctacacatttgccttgttttagaaagtcaacagtgttcatgtgtagaacatttttaaacattaaataggattatggcattttaatgaaagacaataaaaattgatcacccctgcttaaagccttcattggtttctttgtgtaaatttcataagggatgtcagttactttttttctgtgaacagagacctttttgatacatatttgacttgatgcccagttggaagattagacatataaaagctttcttgagcccaggaaacagtggatgttacaacttgtttcaaaggctcttaaaaatttttttttaaagatcttagcttgaacataaaaagggaagttttattaataatattgctgtttgtagttagttcacacaaatagcaaataagagaaaatgtattatattgaacaattttctataattccaaatttcctatttctgataatatagagttgacagctaaatattaataattttaatttgcatcaacaggctttcttaagcatatcagttgagagaaattaaaaaaatagtttttttttgctcacagatgtaatagaaattgatgaagctttctgtatttggtaaaagtgtgtgtgggaatgtgtatgtgtatatgtctatattaacatttatgtaaatgaatgtgtgtgtgcacatgtatcactaatgccataaaataaagtaacattagaaaaatacaggaagaggtaatgaaataattgcacttagtttgaaaatagtaaagctattttagaaacattaaaattaaagtatggtccaacatcattcatatagcaaatgatgctattcgaatttcttaaatgtaaatatctcactaataatataatgttctcataaaatttcagctcccagtgaagccccaacagaagtaggtgtaaaagtcttatcatcttctgagatatctgttcattgggaacatgttttagaaaaaatagtggaaagctatcaggtacgttaaatttttatcaaactaaatacatttattcataaatatataagcatacgttttcaaatgtgttgtatgtttcaatgtcccattaatttatgtggcaactaatactttattctctgtgtctagtattgtggtcatatataagttaattgttaagaataaaacaggggttcctaactggcctatctaggggagatgtaaagaaacctaagtcctggcaaacaattggccaaaataaaaactatggtaataacacttatgattacccaaggtctttttaggaaaacattctcataaaaagctagtgaatctcaagttttttggaaagcattttggtaatttatagaagcatcctgaaaatagtcatcctctttgagtcagtagttccatttcgaaaagtccctccaaagtaaacaattttaaatataccgaatatgtcttatgttatctatgaagtaacaatcaaaatgacccaaataaaacttcccttgagcttaattttaaagaaccagtaagaatcagtcagacgcaaatgagaaaacttgtcttagtcaagggagtaaaaactggaaaatcaaaactagagagattagttagggtctttaatacaatgctaatgcaatttagactgagttatgtaggaaatgtgaaatcatcatctcacatttttaagtgcaagaagtgaaaattcaaaggaattaacatggtttttcctttacagatgagcaaatggataccaaagagatttgacaacttgcctgagttgtcacttacagaaagtgtcagagcagtgtctaaaactcaagttgtctgattcaaagttcggggttttattgccacacatcacagacttccctgttttttttttcagtgagtgctgtctagggctgcctctccacccaccccactcccccagccagcttgcattctcagcttcagcaccctcccttatcccttgtccatggaatattagccccatgagggcagggtattgttctattctcagtgccatgcaagaccagtgctgagcacctggcaggctctaaatagatattaattgaatactgataggaataatgaagtatgattaaataaaatgttacaattgggctttctcaaggccatgtttctgagatgtagctgtaaaagaaactcaaggctttgagcagacacacccagaccaacaggaagctttttttttttttttttgacacaataggttataatttgggaagatcttaaagagccctcagatcatctatgcaagggttcagctgaatttattacagtacacagaagagtagactgggaataattagactgagaatacccaatattcataacttactaacctgacaattgtgtttgcggctagtaggaaagagagaaattcactagatgttacaaacccctgtaataaatacgcctgaggtatctttgggagaagacatcaatgtgtagagcttggaaagtaaaattttggagcacaggatttttttcttcttttatattatttatttctaactaataaatattgaaaaaaggataatttaacatataacccatatcattgagtcaaaatgccaaatatatgacatattttactttatttaaaacatgctagaaaattatatattatctttgttaatgccaagaattatatattgacgatttgcttacttttaacaagaagaagacaaaagaaataagaggtaggaagcaacatagtggaaccaatgattcagatgataattaaattaaatatgcttttttaattgggaactaaaccttgattaaggattttcacatagtcagtaaaaagtaatctttatcaaagaagatttttttcaaatgataatttcaagggaaaagtatgtaccatgaggagttggtttcacagatgtctgaccttttccaacttacattaagtaaaaacttatgcactttgctgctgagcaaacatgggtttatatttcagctctgtcacttaagaattttgtagaaaattgatttgaactttgagtttcctcacctataaagtgagaaagtaaccactgcctcatagaactgttatgtgaaagatattaaataacctgtatttaagaattttccctgtttatgtcattgggcattccaagatggtggtgatgatgatgatgctgatggcagtgaggaagatgatgatgatgttaatgatgaaaagactgataacacgtcttgagttcttattgtgctaaacacttaactaagctcattttattaaatccacacaaccctagaggatagacactattattatccctattttagagatgaagaacttgaggattagaaatgtttgtctgagtaataattgtcataatcagattttaatctagttcttgcctctccagagaacggttgattaaaattgctggaagtaaatcatagaattattcttcccattcattctttcttaaaatccttttaaaccttttacacagggtcttggatatcaaagagacaagcacgaacacttaaaagagaaaaatccatattatttattgttctgcaggaaatgctcctgtgactgtggccggtaggggggaggggggtcttgactgactataatgtggttattgtttccattttaaaatatgatgggagaagccaatggtttaacaagatagatgatggtgaaaaccaataccccaatgcacttcccatgaaaatgtacgatggatctctatttttctgtgtataaagatacacagaaagaaagcagcacattgaaaacataaaatataaagctggaaagccctgactcctgcctgattgacaccatctcaaggttcatttcctgacatttcaaatgagaattgtgagcaattgaatttaaagacaatctcttcccttgtggttttaaagtgtatctcagtagaatgtttatgtcacttagtatttttttatcttacttggttaaagagctccccactttcaatcttaatacccagggagtttttctatagtgtaggtaagctagaagaatacaagaagtctttcttatcaagggcattttggaactttgggctcttgcccaggaatccacaaaagacttagtttgctcacacagtgggtaaaatattcacttaattaatttaacaaaaatgagtaaaataggctaccaggaataatgaatgcaaaaactttagcacctaaattagagattaatgcagatgactgatttcagtcatcataaaagatgaacaatcctgtatagtctactcaaatatttttaaagtttaaattattatggtgagccgaaactgattacttagaaagtgctttattttcttattttggagaagacatccgttttggtctgaatctctttgaaacagagcctcaaacaaagatgtggagaaaggttgtttattattgttgttaattgtttgttttcaatatgatcctaggaagcaggtatgaggaaaaggcagagtgaacaggaaagaggggagctcagatacaaacgtgctatttgtcttgttggcaaccactgtgggcaactggtactccatcccttgagacctttgaggagttttataaatgtgcctctgaagctgccctgcttgggatgaaaagggaagcattcatccacttctgaatgtccagaaatgtgctcattcaacacataaacctcacttttgtgaagtgaatttgagccatcctgttgcacttcataatagtttcttacatgtttatgtaaataaaaaatgcaggattatattattattagacattttaatctaggcattttggttaattgtgaaattacaatcccgttattttatagacagggcatctaaaatatgtaaaatatcaggatagttacaaataatccttttctttttattcttatattacatataacatatttttattcattttattcataccttagatataattataaatcttgaatgcaaaaaagcctttatttaaagatgaaaattataatccataacttttcttaaactttaagagaaaagtaatcctgtaattatttgacaaaagtaatcatttctaatgaaaaaatcgataacttttttaaaaattattttatgggtaaataatttctacagtttatccagttattagatatatttctttgatatctagcttctatatgggttcaaaggaaataacattagatacttctgaaaggaggcagaagaaagtattactttagcgtattctaggccacatagtaactatttttatccagcaaaattatattcctctccaactgctttaagaatggctcagaagaagtttgaaatcatgcaaacagaagtaaaacaggaaataaatgataaaaattatagtgacaaatacttccaaatggagaccacttttatattttgaaagtaagtctgcttcaaagtttttgggatttttaaattttttattttttattttttttagtcaatgtaaaacaattttgggcaatgaagtaagactttgattcgcttttggcatctttagtcattcctgccctgtatgctttactatattctaaggctgataaaagggtagatatcattaagaaacatttgaaaatatgatgatcagccaacaccaatggtaatagaaccagttgaagagaacttttcatagctgaagactctaaatcatggcaaaatataactcatcctgaatgtttgcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacgtgagtctcacgttttgtttttagacttgtcaaaaactaccactggattcaatcatgatacgaatatatttgaaggaaatttcctacctagctacctgagcacatttttcaatatcctttacagccacacaagatttcccttaaaacgtgaattattgtagatgatgaaaaaatgtgaaaaataccctcacacgttaaatattccattatagaaataaagttagagaactatccttttgtaaaggctgtcctctcaaattctgtgccattaacttgtctttaccctgtacttattaatttaaacattgttttcataggagtacatcaacagcatgtgaaaactaaaattctgcttatttttacatgctttaatttataaacctctgtcattgcacagtgcaatgcaagttaagtgtgtagcattatgcttactctcttattactgtatgttctagtactgtatgttttaggtggttcataaaacaagaccgcctatccctgctcacgttctggtcattctaatctctctgggttcattttgatatctctgttcttgaacccaagtggaataagtaaaaaggagaatttttatgtaggactctagggaatgtctcaagaatctgaagatgtgattaccattagagtgtgaaaatttatgaaattcactttgggacagagactctcccagtgagatgacagaatgtagtgacaagaactagaatttggtgtctaacatgtgtttgagatctgtctctgccacttgctagatgtatgacaatagataaattacctatttaaacctcagttttctaatttgtaaaaggagcattcatttttgttctttttccatttgttcatgtatttattcattcatcaaaaatatgctgtgtgctcagcactattcttgatggtgaggatacaaaagggatcaaaccagtccaaggtgctattctcgcatggtttacaagctaatgaaatgagatagaaacttcaaacaaacacaaactctgacaaataaataagtgggattaaagcagctgacagggcaataaaatgaataaatagacaaaagtaaagtgacttagataaaagtgaaattctgattgggtggccaggaaaggcctctgagaagatgccagttaagctatgatttgagtgataaatgataagaagaacccactatgtgaatagctttaggcagagccttaaggttctttgcactctaagtagtacaaaaccttaaggtgaagagcacttaaaatattttaggtgtggaaaggccactgggtccagggcataggttctgagtaaggagggggaagtgttctggggcccaattacggagaaccttgtaagtaattgtgatgagtttgagttctttctaaacatgataagaagccattgaaagattttaaaacagagagtgatatctaatttatgatgttgtttttaaaaaagtcattctggcatctgtacagaaaatggattgtggtgggttaacagtggaagcagaaaagccagttaggagactatttcagcagtcaaggagagaattgatagtggctagcactaagtgaaaatggagacagaagtggaaagttttctgtaggcagagttgacaacttgctgccaatttggatgttggcaatgagtgggatgagagactaaataccaaatttctgcttgagaaactagggggttggttgtgccatttgctgacgatggcaaagagtcattggagaaagatttgaggatactcgacattatattacatttgaaaaatgtattacatttgattatattacatttgagaaatcttttagagactcaagtagaaataggctgatatctgcctagacagagagacctatagccacatatgtctagaggttgaaagagagattagggctagagacagaactgtgaatatttaaagccatgggcctaagtgtcagtacttagggaagatccacagagagagtagaaaaggtacatagatgaagtcctaaatcatccaacagttacaagttgacagagggagccagctaagcatgaataatgggaagcagcagcccatgaggtagaaggaaaacccagttgttaagatctgaatttaagaaaaaatgagagattcaagaaagaagatggtcaattctgtgaaatgctccaaaaatgttaaatttaaaaaagaataatcaagtgacattagatttaaccaagtggaggtgattgatgaccttgcaaatagcaatttcaaaagactagtggagaaagaaacccaagtggagcatgatgagaagagaataaaagtcatattacctagctcacagggccatggggtacattaaatggactcatggatgtaaagtgcttagcatagtgcctggcatatagtaaacacttattaaaactagatggtggtggtcattatcatcagcattataatacctgatgcaatagagtatgcagaattgagattggatatagtgaccactgattgcatattactacttttcacagctcctagccagcctccaaggatcatcagttcagtaaggtctggttcacgctatataatcacctgggatcatgtcgttgcactatcaaatgaatctacagtgacgggatataaggtatatacaaatagtgatgattaatgtttgcaattcttgctatttcagtgaaacccaagatgggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttagtagagacagggtttcaccgtcttggccagggtggtctcgaactcctgaccccaaattatccacctacctcaacttcccaaagtgctgggattacaggcatgagccaccacggctggccccattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggagagagaacgaaactatttttgtttggcaatgattatgatagggttgcccagcacccagaaaactccttgataaactgagttactgtttataaatgaataaaaaggagaaaagcttattttaaatatattctttatatcacacactatcacatttttcactggataccaaattttatggaaaatggtaaaaataaaaattgagagacaattttcagaccatttcaatatattttaaaagttctcattttggacttttttcttaaaaagactcattctttctatatttttattttgggtcatctcaaaaaataaaattcagatgcttaagtcacatctccttggataatcctacaaacttgcaaaaatcaactattgtgaattgaaactaacatgatttttttcatctagttttaaatttagtttttcctcttgttttaaatttattactttttgttaatcaaagtataagcatttttattctggttttagtgttagagcattggctcattattatgactttactgcatatttacatttctgtactttataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtaagtgagtcatttaagacacatttcaactaagtacttgtgagtttctagaccctgtggattcccaagggtagggataagcctgatacaccagtgtccatattttcctaagtagattggacatatcaaggattccctgaaacttggtatttctcctcttatgagtcacaaaagtaagtctgtgacataccacatacttcttgattattatctggatgtcaaagcacagttgaaatctttcagacataagacgaacgagtttttgggatccaatatacagtatggaacatattagtttatttgattgtggtaatcattatacaatgtatacatatatcaaatcttcatgttgttcaccttgaatatatttaatctttgtcagttaaatattttcaaataaaaagcacaattaaaatggcataatttattgaatactatataatactaggctattatttaataataaccaaacttctatcaaaaggaaatacactaggctatttttaatactcttataactctttcacttggactatagatattgatatagtagtaaaagagaaaaacactaaattatagcccctttgtcttttctctttctctatcttatctattccttttctacaaactctatttctcacacctttgtttgatttggaaatacatatatttgaggcagtcatttctttttttttatttctggcaatctgttatttaatttttgacatatttttcttaacctatatgcatgatatagtttaattatactgaatttcaatagatgttaatttgagaaatgtatgagaggctttgacattaccagaagatcctagaacaaagatgataataaataatttataagaaaatttggttaatctgtacaacaaaccccatgacacaagtttacctgtataacaaatctgcacatatacccctgaacttaaaataaaagttaaattttaagaaaactaaaaaaaaagaaaattgaaaatttggtgattttgatataaagaaataaatatgctatatattaaaccaacaaaaaatcctttaccacaatgccagagtatttaatggtatttaataaatgctggcttcaattgtatgccatgtttttgtgaagtttgccacaatacatatatacatcctttacaaatcaaaatagaactttgattttttttagtttaatcatcagcaattttgtcttttaagaaaatagagaaattacagagatgtgaaaggaaaagaaaataatcatgttccaaataccctaaaatagctactgttaatgcttagttgaatttacttatagtcactctgtatacatatataatttcatgtttcagcttccatttttgtaaattatttaaaaattataaatgatattctttcaaacaaatatgcaaactcattaaagtttttttctatcataaataatacttttagagtccattttcataaattaatctttcttctggttaaatttaagacaaagtgttttaggttgctaaatttcttcaaaaacacttactaatttctattcctattatcattgagtataagtgcttttctcactgtaccactctaatattattgtctttttagtcattgctaatttgacaggggaaaatagaattttcttatttttgaaacattttctatattcagaactttgtcaacatcttcaatagttttacacttagtgggcagtttcacaaaaggaaatcagagggaaatatggccattatttcaaggaaggtaaagcacaaataactaaataaattgctcttgaaccctgggccttctttctcttgtgtagaagccagccacagcgagcttttgctctctgtactcacccttggttcatcattcctcaccgaaaggagaacctagcttctgggatttagactagaggttttcagcaagagatgatgtagcagtgatggtaacatcagtttacctatcactaatggcactggtaaatgttaaacagtagaatcactagggataggggaaagccctgtttataatgtttgcctgtttctgtggtgtaaatattctcattatgtgtgatttcaagctttccaagtgatgtcacttaatatggagctgtgaagagctacccagtagcacatcattatatgtaattgccaccatacaggtataataagaacctaaaaaacatttgacaacattataatatagtaaaatattaagaaatgatgggttttgagtatttactacatttgttttaagcttttaaatttaagtttacataaattctattttaataattacatttttaacacattgctcatacatttcctaaaaatttaacaattggatttcaggggttgtatcggttgatttcagcataccacagctgtaatttgatatttcagtatatatagctcatgtatagaagagtatttttttaatcccaaacttaggatatttttcatatttttctctttttgccaactaatggacaacattcttattgattttagaatttctattatttatctcttattctgaccataactgtacaaataaactgtagaattaacgttatgaaatgtcagatgcttggtgaataacaccattctagaatattcttgtttttaagtttggattttcaaatcatttaaattattttaatgaggcaaatgtgtaaatacaaacagaaattacaggtttttttctaaatttaaaagactcttagtactttcttttggttttcatgccctaaatacgtagccaggattataacacactactagatcttaatgtttataagcattatgctgtttgttcattcattcattcaacaaatagacattaaatgcctacaatacagcaatcacagttcacatatttaaaatgtgctaagatttacatatttccacatctctgcctggccctgctgcaattctaatgatcctcttgcctcccagtgttggcctctcaaggcctattatctatgcaatagacaggggggttttttaaaacacaaatcaaatcatataactctcctgttagaaagatggctcacagggaatggtgtgaaccctggaggtggtgcttgcagtgagccgaaatcgcgccactgcactccagcctgggcgacagagcgagactccgtctcaaaaaaaaaaaaaaaagaaaaagaaaaaaaagaaagaaagatggctcacaggtaacatctacatttcttactgtggcctatagtggtctatataatccaccctctctctcatctcaattaagtgctttgtccctttctctgttgacatttctcttcttgaacacaccagtgttatccctgccttgaggcatctctacttgttctcccttctgcctggaattctctggatcttggcatgttagtttcattctcatcattcttgtttctgttctgatgtcacttcctcagaaaagctctatatatggccagcaattaaggtagcaggctactctgagtaaatcttccttatatcatagcactgtttacttttcatcctaatgttagtaaccatgtaaaattatcttatttattaatttgtatttgtttatcatgtctctccatccttacttgaagctaagctccatgggagcaagctcttgtttgcctcagttgacctttgaatctccagcacttaggggactatctggcatgtagcagggttttaaaaaataactgttgaattaattcatgatttctgtatagagaaaagcccactaacaagaataacttgggcaacttaaaactatagttttcatctctagaaaactgatatacttccccattaggttcatgatttatattatttcatgtgctgatccgcaaatttgattcttaaaaaaataagacttccttttagacatattttggaaatatttcagatttgattatctgtaactgcacttctatctgacttgaacactgttatccattgctttaataacttattccttattgaatatttgtagtgcatatcaaggcaaatgtaacaccacaaatgtttcatcacacatatactatctctaataattctatattatccttcaaaaaccgtttttaataattatgagcaaattaagaaaatatacatatagctataattttcaatattaatttccataagctaatttggattactacatattttctataaattttagaatatcaattgacaaggatccttggtcataaataaatatcctcagagaagcacatatttaattatttgtagtgagcatgcatattttaagtctttacttttctttttagttttaaatagactatagatagctgaatcaagaaagactgcagaacattttagagtctgaacatttttctacggaaaagaagtagtcatttgaaatttttaaggtaggagtaacatgatcagattttctcacttggaaaatcatattggtgattgtcgaaaatatgtataggaggggactaagatataaggagatgaagtaccaggttattgccatagaatgattaaaagataatgatgtcctgggccgggtgcagtggctcacgcctgtaatcccagcactttgggaggccgaggcaagcggatcgcgaggtcaggagattgagagcatcatggctaacatggtgataccccgtctctactaaaaatacaaaaaaaaaaaaaaaaaattagccgggcgtggtggcgggcacctgtagtcccacctactcgggaggctgaggcaggagaatggtgtgaatccaagaggcggagcttgcagtgagctgagattgagccactgcactccagcctgggcgacagagtgagactccacctcaaaaaaataaaaataaaaaaataatgatgtcatgatgtcctgaactggaaagaaggcagtggtggatgtctagggtagattctaaaagagcaaggcattttttccatttgatttaaagttactatatattcattttgtgtattttgtcttctaataaatctgtaatttatcctgatattaccactgatgatgtaatctgtatatttaacctaatatttttgttaactccaagatattaagttaaactgtataaccaaacccactgacttaaacactgtgatggaaaacacattttgttgttttgctttgtcctctcctgccagtagcagaagaaggtctagaaaactattttttgggtagaacttttatatgtttaactccatcactactcctgtcctcccttctccatttcctaagtattgcagtgtaagagggacaagaggatagtaggatgtttagattcatttcatatgttattacatttagtctgtgattaagatacaatcagatattatcattcaggaaatgctgtctcttcaaccatcttgaaataaccaaatattttgttttcctttaccccatttttcatgggatcaatttgagtattcaagtatataaatctagcctatatattttagattgacaaatagcttacatttaaattacctctaaaatgcatattctcttcattaccattgaatcatgactaatcactcaaagccttgcctaaccacataaatgtacttagcactcccagttttgtaacaaacatgaagttggaagataaattatttggacaaagtaatattgtgtgagtctctaaattcaactttgggaggcaactcatagccttgatgattattaacataactcctgcagtgactaggtttgatccagcagttgttggacaactcccagcacagggagtttccagagccttaattgtccttcagaagctttgagtacaacttctagaagcacattttaatattttaactatatgtcaggccgtgaacagcacctctgtatctaaactaacctaggttttttcaaattttccctaaggtttccattagctgctaccaagttctcacaacaacttcaatattttattttgctcatttagttagactcagaaataattttgctgaaacattccttgatggaacacatgtaagaatggaaaggaaattttaaaataatcctccaagatgtactttctaccagaataattttcattaatgaaataaagtcttagcctccagagttatattttagtattataatgtgccaatgatttttttctacgataaaataaaacttactcttcaaacattacagattttcaaaaacattttgttctctagtaaattaattcattcaataagtgtctaaacaccaaccatatgtcaggcattctgctgggctattggttacaataattgcaaaccctcctgaagctcccattctaatggatatcagaagaataaagaaccaacaaacaaataataaaacaattagatttaataaaaacacaaggaaaaatgagtggctctttatatttttctttatatttaaagagaaaaacaggtacacaagtttttggtaggatgattaggtcaagcctcactaagaaggtgatgtaggctgaaatctaaaggacaggaactagccatatgacaaaagtgtgggtaaaggaagagcttgtcatgtcaaggacctgaaaggaggctggtgtaactagtgtgtagtgaggatacagagtcatatgggatgaggttggagaggtaagaggggtaaagttatgaacagcctggcattgattacatctaaaaggcaatactcagatgtttgtaatttcttgtaagttcaatagaaaaatgttgatgtgctttcaggagatgaaggacatgatctaatttaagatcatttgctgcttttgtgcagaaaatagattggagtgagacaagaggggagggagttgatagagctagtgaaaagaaagcaagtctgagacacaatcagaacaaggcactctctttcagaaataattaatttataggctactgtaggtttttttatgactctaagaagcaaagcaaatcatgacaagatcttttccaggataaatggttaaagagtgtatgtgaagactccagcttcttcttttctatgacttcccaattcttccccttctgccttttggtggcaggagagtctggagggaatgtagtgtccacatttttaccccagggagatgcaggagggcattgagagcaagaagaatgatgctgagattctgagagaaaatgcttcataccttctaaaaaaataaagagttttttatggtaatcatcaagactaacttagagaaccaagccaaatgtggactttttaggaaacatgaaatgaaatgaaagaaggacaataaattagctcttagcttctaaatcagtttcatggtatataaattgatatttttagtagcaccattaaaattatagaacaaaagctccagatgttgaagtgatatgatgatgatatttacaagcaagatttacccaagattcagaaaatagtgattaatataacctaatcaccaaggcccacagataatagtgtagccattatatttagttacttcccatattttcattttcagtattatgataacctcataatggatatctttgtatatagaccttttttctggattcccaattattttcttagaatgattgctagaagtgcaatgactggattaaagggaatgactttttaaaggcttggcatatacttgccaaactgtcatctaaacagcaatgcctgcattttatcattaaacaaatttttgtagcattttgtccttttaaaaatctttgttaagcaaaaatactatttcactattttttgttactattaatgtaaatatacagatgtatttgacagctgtttatagttccatttctgtaaaattctgttcatgccctttctatgtttcatgttaagaactttctttaaaatgttataatcaatgtataaaggaagattataaaacttttcctgccatatttgtgtaaatatttttccaggtttgtttttaaatgttattaatgatggattggtatggtttatttttatgcaaaatgatgaattctgattataaaagttcccaaatatttaacgttgaacataaacagaaagtcacaaaataatacatataaggtcatgcatcacataacaaagtttccatcaatgatgtaccacatataagatggtggtcccataagattataattctacacttttgctgtaccttttctatatttatgtatgtatatatatatacaaatacttgccattgtattacaattggctacagtattcagcacagtaatatgcttatgctgtggaggtctgtatcctgagagcaataggttataaatacactatgccttctaggtatagtcatatgttcgcacaatgaggaagttgcctaatgacatttctgtgaagacattcctgtcattaagcaacgcataactataagcccatttatatgaagtttaaaattagaaaatacattgatgtttaaaggggtttgtgtgtttaatacacacacacacacacacacacacacacacacacacacatatttatatataacatgtgaaacttcctcaaaaaattcagtccagtgttgcctctgtggagtgatgggggaattatcaggaagaggcttctggggtagtgcctgtgttctatttatttgcctggctggtgagtacaaaggcattgatggtattgtttttaaattatgtttttaggccagacatggtggctcatgcctatagtcccagcactttgggaggccaaggtgggtggataacttgaggccagaagtttgagacaagcctgaccaaagtggtgaaaccccatctctactaaaaatatgaaaattagccgggcatggtggcacacacctgtaatcccagctactcaggaggctgatgcaggagaattgcttgaacccaggagactgaagttgcagtgagccaagatggccaccacatgctagcctgggcaacagagtgagagtccatctcaaaaataaatgaataaataaataaataaagttttaaaaattactaatttacataatttattttaaagtggcaaaagtcaaaagaaggttgaagtagttgagtaaaggatagttagtttggcactttggaggtctatgtattagttttctagagctgtcatgacagtacacagactgggtggctttgttcattttctcaattttgggggctagatcaagatgttggcagggttggtgtcttctaaggtccctctccttggcttgtagatggccgtgtcttcccatggccttccctcagtgtgtgtgtgtgcaagcatgtgtgttgtactttcttcttcttataaggactgatttgtattgctttagacccactctaatgactttattgaaagaccctatcccaaatgcagtcactttctgaggtactagggggttagaacttcgatatatgaacttgagagggacaaaattctgcccaaacagaggtcattggtaggttcaagagagcaactttcacaaaatagtgtgggtgaaagtcttatttctctaagcaaacctcatagaactcacattttaaagcgaggaggcaaaataaataatatatagcaatacataaagttttgtcagatagtgatagtatctgaaggtagctgaggaaggtaaagagaggtgggagagagcaagggcatctgttttcactaagagtgcagggaggggcttattctgataaggaaatgcttgaaaaaaaatggaataaagtgagagaaaagttgaagaagttatctggagagaaggaaatgtattcccaccagaacagtacgaaagccctgaactggctgtatgtttagatgttcaaggaacagcaaggagaccagtacggctggggccaagcaagccatgaggtgaatctgaatcatagagttttataggtcctgattaaggactttagattttatcctaaaggtgatgagaagccattgaaccagtttaaggtgggaagtgacatgatcagatttatattttacaatagagcatctcaaccactctttggaagggaagtagaaatctcatgaatggtggtgcaaatctctgtgaatctctggaaacagggggatcagttaggtgatagtccaagcaagagatgaagatagctttgactagtgtactaagagtagaagtgggaggcagttatattaaggatttatatggaggaagacccaacagtattttctgatgattttatgaggtatgtgaaatggatatggcagaactttaaggatttagacagaccagcacaatcatctcctgaaacaactagcagaattatatattaaaacagaatcatctactgaaaatacatgaagaaaagaaggagtacttcaaattttgacaagctgagttcaatatgctagttcaatatgcctatgagacatcccagtggagagagagaaaaagagaatcatctagcaaaactgagaaagcagctgaggtcagatgacataaacttgtcagagaaccaactggcataattatataactttatttgcaatgcataccagcctggatggagatggaggaaacagagatagcagatgtttcttggtgttgcccaaagttggcaaatggcatggttaatataagtggagatcaaggaaaacaaggatttattacttctagttaaagaataattaaaattgctgaacagagtcagtattatatattatgaatattagaatattttcagctgttagtaacaaactctcaactcaactctcaactcaaaattgcttaagaaagcccctgtggaatcagtgtctcaaaaatataactaaagaacaatttttccccatttctccacttgagaggcctcagcttcattctaaggcttgttccctctgtggttgaaagattctgcagatgtgttaggaatcacacagaccctataatgtccaagaaagaagagggtctgtctcttttgaagcttcatcttcaaaggaagcccagcttttaacagaagctcctcagaaaaaccttccccataatgttcagaagtgtgtcaaaagtctttccttaaactagttaaatatcatttctataattgctcaaagcgatcaagattcatggctggtctgtgattgagaaaaccttccttgatgagtgaataatatctgaacaaaatatgaagagtattagcaaagaagcagagagagaaagattttttgcatgatgttcaaagttaaatagtgaggtaaataaacacagacataggatatacatttagagaaattagagacgaggaaattaggtcaaagagcagcttcataaaaatgcagagaaagttactttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattctattctctttgaagcaattgtgaatgggagttcactcatgatttggctctctgtttgtctgtgattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgactaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttttgcatctattgagataatcatgtggtttttgtctttggttctgtttatatgctggattacatttactgatttgcatatattgaaccagccttgcatcccagggatgaagcccacttgatcatggtggataagctttttgatgtgctgctggatttgacttgccagtattttattgaggatttttgcatcaatgttcatcaaggatattggtctaaaattttcttttttggttgtgtctctgcccggctttggtatcaggatgatgccggcctcataaaatgagttagggaggattccctctttttctattgattggaatagtttcagaaggaatggtatcagtttctccttgtacctctggtagaatttggctgtgaatccatctggtcctggactctttttggttggtaaactattgattattgccacaatttcagagcctgttattggtctattcagagagtcaacttcgtcctggtttagtcttgggagggtgtatgtgtcaaggaatttatccatttcttctagattttctagtttatttgcgtagaggtgtttgtggtattctccaatggtagtttgtatttctgtgggatcagtggtgatatcctctttatcattttttattgcgtctgtttgattcttctctcttttcttctttatttgtcttgctagcggtctatcaattttgttgatcctttcaaaaaactagctcctgggggctttaattttttgaagggttttttctgtctctatttccttcagttctgctctgattttagttatttcttgccttctgctagcttttgaatatgtttgctcttgcttttctagttcttttaattgtgatgttagggtgtcagttttggatctttcctgctttctcttatgggcatttagtattataaatttccccctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgggtttcttaatcctgagttctagtttgattgcactgtggtctgagagacagtttgttataatttctgttcttttacatttgctgaggagtgctttacttccaactgtgtggtcaattttggaataggtgtggtgtggtgctgaaaaaaaatgtatattctgttgatttggggtggagagttctgtagatgtctattaggtccgcttggtgcagagctgaggtcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgccatccccctcaagctaccaatgactttcttcacagaattggaaaaaactactttaaagttcatatggaaccaaaaaagagcctgcattgccaagtcaatcctaagccaaaagaactaagctggaggcatcacactacctgacttcaaactatactacaagtctacagtaaccaaaacagcatggtactggtaccaaaacagagatatagatcaatggaacagaacagagccctcagaaataatgccgcatatctacaactatctgatctttgacaaacctgggaaaaacaagcaatggggaaaggattccctatttaataaatggtgctgggaaaactggctagccatatgtagaaagctgaaactggatcccttctttacaccttatacaaaaattaattcaagatggattaaagacttacatgttagacctaaaaccataaaaaccctagaagaaaacctaggcattaccattcaagacataggcatgggcaaggacttcatgtctaaaacaccaaaagcaatggcaacaaaagccaaaattgacaaatgggatctaattaaactaaagagctcctgcacagcaaaagaaactaccatcagagtgaacaggcaacctacaaaatgggagaaaatttttgccacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacatgaaaaaatgctcatcatcactggccatcagagaaatgcaaatgaaaaccacaatgagataccatcttacaccagttagaatggtgatcattaaaaagtcaggaaacaacaggtgctggagaggatatggagaaataggaacacttttacactgttggtgggactgtaaactagttcaaccattgtggaagtccgtgtggcaattcctcaggggtctagaactagaaataccatttgacccagccatcccattactgggtatatacccaaaggactttaaatcatgctgctataaagacacatgcacacgtatgtttatagaggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggtgggatagcattaggagatatacctaatgctaaatgacgagttaatgggtgcagcacaacagcatggcacatgtatatatatgtaactaacctgcacattgtgcacatgtaccctaaaacttaaagtataataataataaaataaataaaaaaataaaataaaaaattcagagaaagagtaatggaaatttacagaaaggctaggatgttagcttcaaaatgcaggattgttttggattcaagaaacagaaattgctgacaagatggatactgagattaaaacaatttatgatgctgggtaaattgccaaggattatgtcaataagttgagttgtaagaattctggtgcaaacaaagtcagtaaacacaggtttatcctttaaaaatatattatttggctctatcactgttaaataacatttaagtagtcaagtagagaggaatatttaaggattggtttacatcattaatgacataaaaattgtaaatgtttttgttttgttttatattttagattagttattccacaattttgaaatctatgaggcaaatccttcacctcaaataactgcatttggtgatgtgttctaaatttagaatgttatactgggagggtagaatctggaaagaatattgctgaaggaactaaaattggaatctagcatgaggaggaactcccatatatagtgagtgctttggaaaaggacgtcagaaattaaagaaattaatcatttttggagaatgtaattatagtgaagaattttcggagaatgaaccaatagtcctaagggagatacctttattcaaagatgatttcatttttctgagtattgggtattagcaaaattttaattttactaaaaagtaatgtgtttctcttacctgtaagtataacaccaaggtttgagaaacttcgttgtaaagtttcaaccaatttatgatatatgcatgaataaattattcatgagaaaatggataatcttttacaatgatttatatgaagaattttaattattggtaagcctaattttgtatttttctatgaatgttgatttactaatgacataaaaagttacattaagatatctattctttacactcaagtggattgaaaacatcctgttcctaaggatgaactaagatacacctacccccgccccaaatcataggatattactttaccttctcttctgaaataagagcaacacaaaagttaattaaaacaatcagattatctttaatagatatatgcatcaaccatcagaacaagacttcaaaattcactttcctttgaaacattataggctgtgttgaaatttgtaaccctcttaggaaaatataaaaacaattgtctgttctgagaaagggagttgggttttaaattttctctcctgaggtttgacacttattcactataacataaatttgaaaaccatttagaaaggaaagtgactttgtgatttttaaaaataaaacccttgaaatttctcataaatattactggaagcctttaatgccatagtaagagggaatataaaatgcttaaactggaaagtgatatgtcaacatattaaaatggtccattcgatactacattagggaccagctttagtgatttatgaaggagcatttaggtctcaaagtaattcccatagttgggtaaggctagaagccaggcctcttggtagattcttcacagtatgagagcagtgcaaaggacattccagaggcagtttttatagacacattctgcaaaatcatccagaccaaaacaaaataaataatttagaacaatttcaagagtatgagattatccagccagtagtccttcttctataaccttccattttagggcctgcatacttgactctcacttctttttcttaaaaatgggctcaaaagcaaataatcagtcttgggtcacatggccaggagaagtaagaagagtgaaggttattgaaggttacagaaaatgcaggaagagtcgagggtgtggcagagtacagagactaactcctcaagtcccttagcccatagagatgccttagaattctgatgtgcctgaaagttgtgaatctttaggatatcaacatccatgtagatgattcatccaatgccatagcttcttaatttatctaacttttcttttctgatgatcttgtcctgtgtcctgcctcagccacccactcatgatcacaaccgaaacaggaattcacagatttcagtgtgaatttgaatttgagggatttctgaaacttggatggtaaaaaattacattataattttcatgaatttctaactgaaatttggcattttaaaatatatgaatttaggtcacatattactctgtcaccaataacaatcaaacatattctcatatatttcagctgttgaagtattacttcaataatacatttcttaaatctgctcctagatcctgttatttaatgtgttaataagcatactatttgaatgtgttagtaacttacatttggtttcttgatacttttataaatgaatttcaatacaataggtttttaaaaaactctatgtattatattttatgcatgtaataagagcattattctcagtattttcagaaatccacagaccactaaacgggtccatgacaccaaaaagtttaagaacccctgtaaatcttaatattactaataactgcaaatttttttctttaattttgattttaaatactgtgttctctgaccactgattcttctttttctagtttatttccttaaatctcctcccaactccagcagttcttctactttcccctacccagactaccagtgatcttattgcttatttcttttttttttttttttttttgtccttcattcatcctcatgtcctcagctcctgccttgaatgtcagctcagattccacggttcatattgaaaacaactgccctatataccttgtccctttccctctttatgcttctcacttggccaaacccaaactcatattaaatataactgttcacattttatgtgtccacatccaggcagaaggcagaagccatatgcccctaccaagatctcccctttgcattcccatcccccttgcattcccatccccaacattcaccctctcaccagcaccacatacctagagactctgagatataatctgttcatgcccttcagccttgtttatgacagtcacctacagaaacccaggagtctctgattaacacggatccaggtgcccattttctgacatctctattcatactttactcttaaaaccttcccactgttccctctaaaactcaccatcagttatcagtagagtcttctgtaacttccatctactcactgagtgcttccttcaccttttaactttatctgaagtcttgctctccctgatgacattgctccttctgcagtctattcaaaagtggtggttctctctcataccccttgaaggctgcacctggtggagggtagttgaccttcctttttgtcacttctacagtattctctttctctcttgcctaaaaagctctgcttggaatcataccatcaccctctcccacccatttccccttcttgtccaagttttctactagcctctagggccactcttactcattccatggagactttacttttcagataattttcattctttccaaatgacattggagagaatgccattctcttttatacttctttcataagttctagtgatacaatgtaggcataaatgatttttgcattactctgtcctctccatttctttctcttattgatgttcttcccacggttctaccctagcccttttcattactatctacataatctcaaacatcctatcctctgcccacttcctatctttactcttacctctggtactcagactcccaaaagtttttgacctatcaggaaggacaagccattgatctgaccactgtctgtgtcccttaccttccttgtatcctcactctttccatatccagcttaaatcccacagccatataatataattattcccttgcatagaccacccattccacccagaagttcccttttgctactctaacttcaccatactcacttggctaaaggagtggattaaatttaactcactacttgctccaagcctacactttcatggctaaaggtggccagagaagaatgccaacacgaacactggtttcaccttgaattcatgaccacaaaacttcaagtgggcccatagtgctgctgggccattccactagattttcctagcacatccactctttctttcacctagaaacctatttcacaccttctttttttctttcctttaatttctaacacatctttaccatcttctctctttagtcaatgaccttgcttcctatttctctgagaaataaaagcaatctgaagcagtcgacacctacacatacgcccatgtgacctgcctttctttctaagatcctggctgaatgttctatgttcctaaggacacccctccacatggaagccagattctaacacctctcgttaattcaagaatattgcttcaactaccctttccttcctcttctacatcattatatttctttttttctatttgatttttctcatcaccatacaagtattctgcaatattgcccacttttaaggggggaaaatacaaataagacaaaacaaaacagagcaacaattgaaagaaagaagaaggaaaaaaatgaaggaaggaaagagggaaggaaggagagaaagagaagaaggagagaaagagaaggaaggaaggaaggaacgaagaaaaacaaaaaaagaaaatctcttccagtaactaacgcatgttctattatcttctttggagtaaaattcaacaaataatttatcatcttcaccacctaattcctcttccaaaattctatcttaaatttgttccaatcagattttcaccacaacaccctgtcaaaacagctcttgtcgaggttgctaatgacctccatgtttctaatttaggagtagtcctctccttactcaagctctcagcagcactgatgcatatggccactttctctttcttggctttctgggcaccagtctgttttgatttttcttttccccttaagagctgccattctcagtctccttttctggtttctggtaatcattccaacctttgaactttaaagtctcccaggactcagtacgtcagtaattcttttcctcttagcccttaggtaatctcatgcagtctcgaggctttaagtgcatgacatgtatttgtagaaaacaatcaaatgtcagtcttctctgatttattcagctgcctgattgctatctccattcagacatctaatttaaactcttccccatctccctttgtttgctttttctgcagttttacccatctcaataaagtatctccaatcttctttgaagtaatttttggcatcattttctttaacacaccacattcatttcatcaagaaatcctgttggttttaccactaaaataaatgtattgagaaacatccacctctgctgctaccatcatagggtccagtcactgtgccttgtctccaggattgttgcactaaccatctaattgtgctcttcgcttggtgcttaacacctacaattcattcttaatataatgaccacagtgattattttaaaatatgtcagctcttctcatgtctctgcacaaaaacctttaatggcttcctatctgagaaggggactagatcatattcatatttgtattttgcctgatctctgccaatctgggtcactaccattaactccccagctcatgacatataaaccagtttctggaaaacataagcctgtttattttatttcccaatgtcctgcaaaatttgatttaactaattaagatgtctgtaatttttttgttttgagatggagtcttgctctatcacccagtctggagtgcagagtagcacaatctcggcttactgcaacctccacctcccaggttcaggcagttatcctgtctcagcctcccaagtagctgggattacaggtgcatgccactaggcccagctaatttttgtacttttagtagagacagggttttgccatgttggccaggctggtcttgaactcctgacctcaggtgatccgcctgcctcggcctcccaaagtgctgggattacaggtgagagccactgcacccagtcaagatgtctataatattattataaatttatgtatgtttttattatttatatgttgcattagtccattctcatactgctataaagaactacctgaaactgggtaatttataaagaaaagaggtttaattgactcacagtttcacaggctgtgcaggaagcatggctgggaaggcctcaggaaacttataatcatggcagaagggtaaaggggaagcaagcacatttgcacacagtggcaagaaagagagaagggggaagtgctacacacttttaaacaaccaggtctcatgagaactcactcactatcacaagaacagcaagggagacattcatccccatgatccaatcaccttccaccaggtccctcccccaacactggggattacagttcaatctgagacttgggtggggacacagccaaaccattatcatatgccttgattatttaacataggtatgttctctttttgcataaatgagaataatggtgtctacctttgatatgagccataaatgaataaattaaacctgtttttatatatcttaaacctttgccacccaattataaccggaagtatgagtgggaaagacaacactctatatcagcatttctcaaactttcttcattattgcctccctaggaagcctcgttacatattatttttccaagtgttaccacttatgaaattttaataccaaaaatctactgtatagctgtttatgttatgtggccctttagagatccaaaactattatgagatttcagattttcccaccccacaagaaccaactttcacttagttggaggccatgttggccctattgagaatgcatgctcggtggagattctcactcattccactccctggagacacagtaaattctatgaatcaatcagtccaaaccttcagtgagctgtgtttttagaacatattgctttgtgatcttttttttttttttttttttgagacggagtcttgctctgtcacccaggctggagtgcagtggtgagatctcggctcactgcaagctctgcctcccaggttcacgccattctcctgcctcagcctcccaagtagctgggactacaggtgcccgccaccatgcccagataatttttttttttattttttagtagagacagcatttcaccgtgttagccaggatggtttcgatctcctgacctcgtgatccacccacctcggcctcccaaagtgctgggattacaggtgtgagccaccgcacccagcctgttttgtgatcttatataattaattttgtattgaattgtactttagtcttatgctattggcttagactgagggcaattaaaaataaagtagagaaacaaaaccaaaaaaaatacacaaaatctactattatattattctacaattgttgaggatatatttctataaaacacatacaaaaatgtcctctttttaaggaactgtgaatgaaagttctctcaggtaggggtgaacctatagaagtgagcaccctggtctaggccaataaataaatatttaatgtctaaataaaataatttaatattaacattaaattagtcttgaaattcctgcatactatgtatttaatggagaagatgagatcttgtaagaggaagaatgcaaggaggatcacttctgtctaaactctggaacagttcatctcctaacatccaccccacacaaacacacacacacacacacacacacacacacacacacacacacacacaaagaaacctacagttaaataatccattctctgtgagcagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagtttatatcccggatatctgcccaactagactgttccataaactttgtctctggtcttaagaccagaagtagataagctcttcctgagacattacttgtttttatcttttggataaagacattggaaactcaatggctgatgtatttccgtgtttgcactgcatggccaaagctcagagccaaatctgctacatgcctatagcaaaatatataaagtattgtatattttactttaaaatgtctgaatatatatgcagtggctttaaaaagtgcctggaacaacacagacacaataaatattagcaatatttgtactagctttagttgatgttgctgctattttggtattacctcttattttgtatcatgtttcctaactttatcttttttcctctcaattttcttatttgttttctttatcatactttatctatctttgtaaactatcagaaagtctttttagaatgaagtagcctataacttataagtaaatatttatattttatcccccaaagaacctggcaaaccattttgactcagtgtttgttttttcaatttaactagcaaaaaaagttctctagataaatactgttggattacaatatctggaagacttcaatagtaaatgtcttaagaacatttatttatcctcaagaactacaaaacatgaatcggatttccagtatatgctttataattaaatttaagccaaaaagaattcttgaaatattatttaaagttataaagaatgcatctaaaatgtgagagccaataaaatctaaagagaaaattcttaaaataaaatggacacaagaagaaaaatgaattaaaaagcacttacatatttagtaaaataaatgtgcttagaaaatagagaactggcatgtgtgatcctaagactacatagatattataatccaagcagaagtctaaaatataaagcaaaccaatttgatagagaaatatttgaagtagaaaaaataatgatgccatcacatttgaaaaatatagtcttcataattcttacattctttcaagtatcccaagtgctttcgtgacattatatagtctgagtttatttttagaaagccttggtttttataaataaaaagacattctttctttttatagagtcactatgaatggctgactaaacttctaaacatataaatacactgccatggatatatgatacccaaaatgaatttgatgtagaggaaaaagtagttcacagacaaaatttatttagattttgtctctttcatgttttcactaaatatatatatatatatatatatatatatatatatatatatttgccaataatgcagtgtcagttctttataaggtggcttattcctggaaactcttgttattttgtaattttgttaattatgttgccctttatattgatgatttagatgtttgaacatatcttttgtagctctctgcagccacatgttattctttttgcttttgctcctgggactgaaaactgtcgtcatcaagaacttttaactaatctttaacagattttaaaataactaacatatatttaaatgtcattacaaataatataatgctagctcatatttattattatacttgttgaactttggattcagttaaaggaataaagaattatttaacttagcattttcttactctgactttttaatccttttttacccatttttaaaataaatacagtgtaccactaaggcaaaagtccccaaaactctattgtcttcttgttctttcattctttaaaaatatatattgtatgccagctcttaattgtgttcatggaaacttgtaaaacactaatcaatattctataagccagataaaataaatataaaaggaaacattttatatctgaattttagaggctaattccctttcctcaaagaaagagaagttatattattctcaaattaaagtgaaaatgagtatgctttcttattgctacttgattatttaggactatatagtgccttaaagtctctatactatcctttctggtataagatttatttttctaaaatttgagaatgataaaattagtaataaattttgctaggagttatagcatcgatattgggaaaaaataaggcaactatattacaggcactagtaaacatagtattatacatatttcctagaacatatttgactataaacatttttctacaaattaagtagatattgttgtcaatgcctaatatcttacctatttttcatggaacataacatgtatgaggcaaggttagttatacacaagatgaaaaatcatggtgaaaatatgattagagtatctgctttagcaaagagagaaatggtaattctctcctcattttaaacataaacaagtttcctatctttataattaacctattgataatataaaccaaagcacttatcacagaacatagcagttgctcaattattttattgatcttcagcagttactaatacattctgtaagctagcacacaaataaggtacttcacatagaataatgtctttaaattacactatcagttgccatgtcacatttaaagaactcattctctagttattagatgtacttgaatgtacttatgtgatttagagaatgtcaagtcatgcaatatatttttgcaaatttgatgaattttcatttatatgtgttaattttaaaatattgtttcaatcatttaatatattttctacacagctctgctgcatggtcaatgaacagtatgtcatttgtggtttatcgtcagccatttttaattagacgaaatccaacattgcaagttttaaaactgaagattaggcatcattccaagtagcaaatatttttgttttggttttcttctaggttaataacttctctgacatttgcacaactgtgtttgaaatatagtctaatagaatatgtatttgccttctataaaattaatgtcctagacgatgataaaatatgttgaagttttaagggaattattttttttattatcttggattggtctatgaattaatgaaatggaaattaatatacatgagaggatcaactataactttacattaatttagagtattataagcagtggcttagaataagagtttactttttgtgaatatccaggataactttcactagcttctccctttttcacaatgcatttcttggtaaatattttgttatcatcacgacagtgggtgtttctaaaacccattcatatattttgccccatctcttcttccttagtgtgttttcctcctcctccaggaaaccccttttctgctgccacctggaagtaccctcctttttgctcccctcatatctttggcattctaagtgcaattgtgtttaccacaccgtactacagttgtggtttactatcattcaaccaagatctcttgagaagaagaaaggccatttctgcacccagtactgaccacagaagtagtgggttcttattaaattgaaattcatgaatggaggtttggcagttaagttttttcctgttatattaaaactgagaagcaatcctaaagaaagaaaaatgacttggatagaaactcacattttaatcacatttagatggttcctgcccacttagttaaaacaactagcatctttatctataagttggatcatgtcaatgtacctttctcagcagtgacttcctctctcttccctctcagcttcccacacagggacattacagccacggatttgctcttactttgaagaagcacgggtacctcagtacctagatcttcttttgagtttgcacaaccttggagatgcagagtagttaagttgtagtcagaagagccctgattcctcccggcttggattaagtggtaccctaaatcctaaataccttctaatgccctttagtctgggcctggccagatacttctttcctgagtccattaccagaaatctttggaatgtggcctgcagagaccacagacaattggcactcatttttcaacaaacaaagtaggttagaaaataattttccagctataataatacaaagagccaccaatcatgaaatatttatttataatagcaatgcactctgtatctttgttaaaataacacaattagctaattgttactatcaccattttactgatgaagtcactgaaattcagagagtttatgtaacttgtccaaagtcctacagctggttaagctaggagccagaattcaaatgatttagttctaacactaaagcatgtgctcttaatctgtatactatgttaggatgggattagttccatatggcaatttttagcaagaacctgatattgggacatgacatagcaacaagagaagagaaacagagatacccagaaatacacaggtcattctataagtaactactatattgcagaataaatagtgaatgccagataggcacagctaaaatttctagcactccaactccaaaccaaattttgttaactatttgggagaggacctgacatagcttctgccattatctaaacagacagaatccacatgattcttggaggaggaaaaaattaaataaactcagattactttcttttaatcttctagactccatccgtacaagtggaaaattcatctgactcagttaaaactaacatatttaaagcaccaattatatagtccaattaaagtattatctaaatataacatttagatcataatttattatattataaatatttggatatttataaatattatatttagatatttataaatatttataatatttagatatttataaatatttataatatttagatatttataaatattataaatatttagatatttataaatattataaatatttagatatttataaatgatatttataaatattataaatatttagatatttataaatattataaatatttagatatttataaatattataaatatttagatatttataaatattatatttagatatttataaatattatatttagatatttataaatattaagatatttatattataaatatttagatatttatattattatatttagatatttataaatattattataaatatttagatattatttataaatatttagataatattttatttcctctaaagaaagagccatgtattcctggtccaagattatattctaaacacaggcttaacttaaaatagaccatgatcactacaaaaaggaagaaaggtgataaataacacttaaaaatctcacatgtacattagtagaccctttacaaggaaaatattattaaagtttaatgtgcaactaatttagctcggtgaaatatttttgatatgtattaaaaaatcaacctatggctagctaacaatgtaattctcagaatatgcaatatcaacataagactctgttcatatttctgaattaagcactttagtggatattggtttagatgggctgattgcttgattttaaatcttatttgatgaatttggaatggaagattaagaaataaaggtagagaggtatgattggagtataagttatatttagactgtgaaaagggagaagattaagtttgtggtctttgctttttgttttctggcgttttggcgtgattttttttatttttatattttgcttttcttatacataagcatgagatgatgagatcctaaacttctaatgcacaggcaataaaggtgaagagtcgtgagagattctagagctatactggagatcaaatcagttggacttggcacccaagttgatatattacaggcgaggaagaaaaagcactttgcaaatgacggcattttctattatgaataattaagtgcatggtacctcatgaactgaactaagtagtgcaggaggatggacaatttttataggagtagtggcaggaatagggagtatagagggagagagaagtggtcctgtgacaaacgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataaatgagtataataagacacaagtcttgaaaagagaaaaagcaataataaccaaaaattgtatgatggaatgaataaaagaagcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaatttgaaaagaacttaaaatttcaaggtttaacaccatgaaactatgactaaggatgagccttttcagaaaagaaggaagtctgaaaaatatataaacagaaccaaggaaattctgtgcagatacaatccaaggtgattagaattattttatatcttcaggttgagaaactgaacaagcacaatctcttagaaattttttagactagtcaatgtccaattctagccagtgactccttacacacttcagactatagttaaaatagctgaaaaattatttctgctgtgaaagtacaaagagaagattcagcttgttatgatcctcttaatagtttcagtgattcaatgaatttggacaatttcttataagaacttcatgtgcatatagcaaaacagagagacaccaattaatcctttttgatagatggatgacactgaattgtgaaataaggtcccaagatctaacaaacaaatgaattcaaggtcataaaaagaagaaaaatcttaatagcaaataccaaataccaatacactaggagaaaaatcttaataccaaataccaaatcttaatgcccttaataccaaataccgatcttaataccaaataccaaaatacagcctcaaacaggtgaatcactcatttgtcatagcctcaaagccaaagatgactgaagaccaacagaactttttgccccagttttatcctgagaaagtttccagggtagttctgtctctgcatcaccatttgaaaccagtgagagaatgggattattggctgtcattgctattgaggcttttagaaacctctagtcattttcaactctcaactcattacattaaggaaggcggcatcactgcattctctagtaatgtttaaagatgtttatgaagcagccaggatgtagaggaaatagtactgggcttagattctggtttatgttcaatacctaagtttactgtcttttaggtatgtaaatataagccctaggtccctaatctgtaaatacaaataatgatacatactttaactgtatcttataagaatttagtaaaataaatgttgtaatgtgtcctagacaaattaggcacttactaagtggtttaaaagaattaaaaaatccattgaacaggccaagtgcagtggcctgagcctgtaatccgagtactttgcagggtcgaggtgagaggattgcttgaatccaggagttccagaccagcctgggcaacattgtgagaccctatatctacgaaaaatataaaaacttagctgggaatggtcatgcatgtctctaatcccatctactcagaaggctgaagtgagaggatcacttgagcctgggaagtaaaggctttggtgagctgtgatcgcatctttgcactcactcaggcaactgagtgagtttgtcggaaaaaaaaaatgaacagatatttgttaatgacatattatggatcaggctgtccagaatcttatgaataaatgaaataattttaaggaaaattgagtctcatggccagttagtttcactctttctctttattgtcaatacccacaaacaccagccagtctccacaaaaaaagagaagcaaagcaatagaacgagcaatttttgtggtgggggatgattgcaagggacagtctttctttgtatgtaaataaacccacagggccatgtatctgttgaaaatgtccaagaagtcctagtcacagtgctcaactggtccttcaagacttgcactgaagaggaaccattaaccttggcatagtggaacatgtaaattttcaaactttctctctggttctacttgtctctttgcctcaaaaactaatttggagaaggcaaggtagaggcagtggaaggaataatttagcacttgtttttataagtatggcaaaatggaatgggcatttgaagttgccagtctttctaactttgattgaggctgagaaaagttactcctggtgataactcagtgtatttcacaaagttggggctgtaaatgtgagaacattctgtcaaatagctatttccaaagccaagtgcacagattacctaataaactggctctggttgttggttaattaatcacaaattaaaaacttgaatgttatttataaaatattttgtatacgttgggaataaaacaaacccatgaaacccattatacataattctatgtattctatagaacagaacccagataccaaggtctgagtctcttctgtcttattccagactgagtatgttctcactaaatactcactaaaaaatcaaatatctttttaaatgaatgaactacatttaatattgcaaattcacaattcatagatggtttttactttgcattttaaccccattatgtaagtattagactcccaattttacaaataagtaaatggagcacagagagatttagtaccttatgagaggccacacactcaagtgagtggtaacagtatgcagatagaattgtctcacctcaagtctcatgcttttgtgtaaatgtcaccttgcatttctaaagaagtaggtaagccagttttaaaagtcctcataattatggtctcaccttgccccaaaatatcaaaattgggcttgttgagcatgtgcttattggccagcttcttataaaagctagaagttgcttttatatttcccagcaaatcaactggtcatcactctattggaaatgctcactcctttctcaaagaggaaatgcatcctggtgatctggtgttttctgacagggaaagggccagagtcaacagtaaggaacaaatacaactgccaggataagctgccagaaaaccatgtacctctgccaaacaaacaaagatctattttgcttggcatgtgggtttgggttcacaattgccaaacgaataggagcagaaagattagtgggcttcactggatggaaaaacccaccgaagccactagcacttagatgatcaagcacttaatgtatatttataaactaatatcaactttgattagcataaataagggaaaatgtaacaaatatgtttgcaaattttatggctcaatgcttgatattctcaaatatattatggtttgcctagaattacagactcagggctgtagtaggaaccttaaaacttataacattaaaccctatcattttacagaaggaaaatccacatccttgagaagtaaaacagccaaagatcacagaagcatcagaaccatgtcttgagcccaaatattctctgttgctaaagttatataactagctattgacagaactagaggtaggtcttaagctgtcttttttcttctctacctagcttagtatttgagtgttgctatctcaagtaggcaaagggaaataaaatcatcaaaagcaaaataagcaagctgatacacagacaatatcataaaatagatattttagggaaaaaacaaaaatcatcaaatgtgcaaaaattctgctgaacctcaaagatcaaacccattttattttctgatttctctttgggtctcttctttagaaactcttaaaaccaattagtgtgactatccattactttattttgtcaaagtcatgaagttaatgcttataataatctaaaattgaaaattacattaacgttttccccaagaaactggtttgaagccaattcagctaactttctaaaaagacacctcctttgttaacattagaccattcataaaaataacaattttgatatatagttcaaagaaaatgttaacagtaacctcactgaattacagcagtgttactgaaaattgtatgctagtttccaggcaagtacaacttttctaccttacagatttgcaagttttacatctcaactctagtctatacttgcattgttgataacatttagacaggatggaaacctggaaagaaaaaaattatgcaagagaaaatgtgcaaggagaaagagacaaagatgagacagaaatgctaaaaatgaatcaagcaataattcaaagattcctttgtttcagacatttcataaaatctcagttaatacatttaaaacatttgtttttacctcaatagcttcacattgaccaagtgttaattcaaggaagtaaatgggactgcatgaattttttaaaattatcattgtcagaaaattaaccatacaataaagtagatttcagtgtctcaaagtaaaacatacctcttcttcttttaatgtttgtttttatatatttctgccacaaaatttaataaaataaatacctaactgatttcctcacctagttctgacagcaatccaatggagaaacaaacacaattcagtaatttgcagaatggaacaccaccagtaaaagaaccccagaaaattcccaactgattagactaagtccaaaacaaagctcttcaccataaatttaccattttttcagacaaattcttatgagtgactaaatttgcaaagtggcaaactcacaccaggcctttctgtacaaataaataagataaaaaatgctgaaaaattcgaacgctgcacctaccttgactgcgtcccagtggttactcataaaaatggatccagtactctgacaagttcactgaaagtgttgtcttcagtagctaaagagagcacttgcttttcttgtgttgattagcctcaagcaattgggaaaatagctaaaagctgagaaaggcaaattagagaggttttaaatgatacaggtgagcaaagtcctgaaacacgtttttccaattaccacaaatttaccagaaaacgtacttttccacagctatgggcagaatataattcctgtgtgatggtccttgatagaaagttactgtggtcaacaagtttgggagatactgattatcctctgttgctttgatgattctcaacatgcatttatttgcactttttagatgagagtagtctcttttttgccccagaactcctcttttgctcctggatccacacagccctttcactgggcaaagtaccgttcctcctgagataagaatgaaagctaccatcttcttacatggccctgcttccttggccagagtgattggttgagtgatggaaagcttctccaaactagttcaatcaaagaagccactaactcagccacagttattggtctggggataggtgtgtgacctgatgtttgcaaagcagagcctttccttaagaatttttcattagtgttggggtaaaacgatagcccagtctgtttgttcttaagaatacgtgatgtgagctaggagctcatatctctcttgagagaagtcagtctgagaatgtgaggcaacaggccgggcgcggtagctcacgcctgtaatcccagcattttgggaagccgaggcgggcggatcacgaggtcaggagttgagaccatcctggctagcacagtgaaaccccatctctactaaaaatacaaaaattagccgggcatggtggcgggcgcctgtagtcccagctactcgggaggctgaggcaggagaatggcgtgaacccgggaggcagagctttcagttagccgagatcgcgccactgcactgcagcctgggcgactgagtgagactccatctcaaaaaaaaaaaaaaaaacaatgtgaggcaaattgtaaaagaacaagaggtgaaagccagagacttggaagatgcaggcattcaattatctgctccagtgtgcctgtaaaacatcagctgttaggttggggttctgtttcttaaaaccaaagatccctgactaccatgctacacaaacactggagctggaagctagactcttacagaaaaactcagtatgcccagcttatgccattgtttgctttattttatccaactacttttccagaaatacagtgcaggtctagaacaagaaataaacttcatgaaatgtagtaggaattgctaccatttactgggagttatctattaatcatgcatttctgaaatgctttacataaagcagttgttttcaaaccgtgataagcagagtcccacatgttccatggggtgatagagttgcgggaagtacaggtgccagcatgaaaatagagaagacaaaaatctggtggtttcctgctcttaaacccatctttgagtaaagcatccccctttcacccagttcaataatggatttccacatataattacttctgaagaaaggttatgctacctctctagatagatagatagatagatagatagatagatgccatgagacatattattatccctattttatagttgaaggaaaaaggtttaatttttttttaattttttcaaattaaaaaaattaaagaacatgctcaagattacccagattatgcagccagtaaaaggcagaggtagagtttgaactttgctttgcctgtttccagaacgtctgactcagctgccatgtgatactgttcccaatatatccttgtggctcctactaggacaggcactcattgcttgctttattttatttttttatttttttgagacggagtctcgctctgtcgcccgggctggagtgcagtggcgccatctccgctcactgcaagctctgcctcccgggttcacgccattctcctgcctcagcctcccgagtagctgggactataggtgcctgccaccaagcccggctacttttttgtatttttagtagaaacggggtttcaccgtgttagccaggatggtctcgaactcctgaccttgtgatccacccgcctgggcctcccaaagtgctgggattacaggcgtgagccaccgcacccggcctcattgcttgctttattgatactcatattagccagcttgtcctgttaaaattaaatagccaaagatcaaacagaaacctgtagtccgacaaagccagagttattgactggatgtagcaaggaaacacacaccagagcaatcatggaataccatgcaggtgcgaaggagaagtgtcttatgtaaggtttgagttcctgctgaagaattctgaggagggtggaaataaactggcagtcagatctggattagttctgtttctgaagtgggaataggagaagcaggaattaactagagctggggctgtcatgaggggagtgcagtccagcaattgggtattcccactaataggtgggacaagaagagcagagctggggcatcattggtaacagcaccatccacttggtgaggaggtcatgatggcattctacagcagctctgtgatcttggtagtgtttcctgtgaactttacagttggcattatccatgtctgtcatacgaatctgaataaaggttttgttatttttctgcctcagctgattttcactctaatcatagggatgtttttactctttcagttctcaaacgtgctgtcccagcaggagttttattgaactcaacaattttcaacgcaagcatccattcatgtgtacctaatatacctcatatatattaggcacacctctaggcagtggggaatcaaccatctaataaaaacactttcttccatatggccagggccattaatagacctcggaagaataaaaaataatgtcggaccaggactagttggaggactcctggactgagtagtaaaatcattgccttctgatattatattatgaatttttaatattatctctttaataggaaaaaactattttctgaggaaaagtaatcataggaaggtataacccctttctttgtccaggttcctagaagttagagagattatgcaatatagaataaaataaaaagaaatatcaggggtcacactgaaggtcacagtggtttcctctaaccatcttcttccttagaccccctgtgctctgtaataagaaaaaattcagggcctacaatggaggcataactcaatcatttaacattataggttgagtactttctatgcactaggcttggtattagtcaacacagctaaaacataatttggatatcatctctgtcttgaagttgttcataatatagagatattagcagttgtggtcacaaaatgtgacaccacaaagagaaaattctaaatgttatggcatcgtcagcaataggcaagcagtagaaacaaagactgcatcacagtgtccagattgaagaatcagaaaggaagtttgtattaaaaaccaagtagagcagttttctacttatcagaaagcctgcagtactgctcaacttttaattgaaatgtctgttttcagcatcactctccatatagcgggaattctccctgaaggaagtatgaaatcaaagtttagatttaaaaaaaaatcaagaattcccatggaagagatatagtactccaaattggttttacatttcttctgatagagaaaaattattcacaagatcaatgatttgttcaggtttaacattcatcagctatgtgaaaagcaaaatatgtgtttactatataacacataagtaccagaattatgattgatagcagtattctgatatatatgttgttagattcaaaaccaatatatattgaaaaactcctcaagaatatatgtcatttaaaatgacattagatagtacttcaattcggtctctaatttctgtttggaatgtgggatagaagtaaagatgaagaccaaaattacataagcttgagccattagagaaattaaatataacacacgtaaacatggagagtttatttcaaatatcctgatgtcaaagccacaaattatgaaattgtatttggttttcatactagtaccaaaacatcaagatggcatccacaattcactaaatttctttcgagcagccacagtttgtactttgccaacccacatattcagccaagtacataaacatgtccccatgatagatgtaatttgtggtcaaaagacagagcattgtggagaccctgcagtcatcctcagacaaaaaaggcttcagaatgatgatttccaattcctatcacaagaacaaaaaaccaaacaccgcatattctcactcataggtgggaattgaacaatgagatcacatggacacaggaaggggaatatcacactctggggactgtggtggggtgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaggcttcaggatggatcatttacactgggtcaaacattgacgtttaaaggttttactgtgtgattgaggtttattattgggcatcttatcagaataaaataatgtgtggtctgtggcatattttaaaaaatttgtagaaaagtagaagataaaaaaaattacaagaatacaaagatctctttgaaacagtttatgtgttagcttttttccatatgacatttattattttccttctgtgcccttgccttgatacattaagtgcagagcgcagtttccttctgcatttctaaaaccagtcccttgctaaagctacctgcaagaacacggcagagaggtcaaaagtgcatggcctttgcagctggacaaatttgaattctaatcccttctctgccctctagtgactattggacttgagcaactcattttacctgactcagttacaaaatatataaaattagggtaaaagacctaccattgtaggttgttgtagtcatgtcataatctacataatgagccaacatagtcttgtagctggctgtagggcagtaagtagcatctctcaaagtaatgataagtttactattgttattgatagtgtccttaggagctctgctacttgagggctgtttatattccccttgttatctgccctcaccttttgaccctcactttcctgctcatttctaagaactactttatctgtatccgataaagctttccctcttatgtttccaggcagctccaaaagccccaggcagggcaatgttgaagacaagcaagcagacagacactattatcttccaccttatagggaacatgaatgtgcttttaatgaccagagattcaggagaaatgcactaaatctccctgaatataaaaggaccatgccaaagaatgagctgtttatggtcacttttaatgtgatagataataataatttatttggtggtttcaaatttagagagtaaacttccaaaaattaatgaaaactgttatattagtaagccattgactaaattttttaggtcttcactcattctagcagcatgttcattgaagatagtgccagccaggcatggtggcttatgcctgtaatcccagcactttgggagactgaggcaggaggatcacatgggcccaggagtttgaggctgcagtcagctatgactgaaccactgcactccagcctgagcaatagaacaagaccctgtatcttaaaaaataataattaatttatttaaaaagaagatagtgcctaatagttgtggacattgggaagaaagagtatgactttttggtcctactttacaatagtttctcaaaaattctcatgtcggcaggacacggacccataaacttacttgactacaggagtagcccttctaagtgtcacccaagacgtaaattaagtccatagcatattataatacatcatttcaatttttaattcacagtgtaatatctcagggcaattgttctttagataaaaattgaatgagattatttaatatcagaaatacattacttaagtcattctgtataaatgtataaatgtcttaaaaccattgggatgtgaaattatgcaagatttacctagcatacctatgttgtcattgtttcaggaaaaattattagtatttttactgtatctctttttttacattttattattattatactttaagttttagggtacatgtgcacaatgtgcaggtttgttacatatgtatacaagtgccatgttggtgtgctgcacccattaactcgtcatttagcattaggtatatctcctaatgctatccctccccactccccccaccccacaactttatcttatttttaaaacttacttttttaatgcatgtatatatgtttcttgacattttgccttctggtaggaatttgggactgctggatcatagggacagcatacacatttgtgatcatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatctcgccttagctgaagcagactaaatgagcaatagtgacatgtatcaatgaaataatatgcacacttttggtttaccttgcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgat

SEQ ID NO: 37501 - DNA, 79911 bp, Homo sapiens
ggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagaggtgtgtgagtgtgcgggagtttctgtgcgagggtgatagggaagcggcggcggggggaggggcagcgcttcccgccttcgccagagacctcacttcctcgcgcggccgctgctgtagctcggtccgtcctgcccgccgccatgttgtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctagggggtgatgaaggaatctgaggctgcggggatgcgcgcgtcttgggctagggcggctggggcaatgaccccctgcggcgcaggcgtggggttgcggcgagagggcgagcctagaggctttaagggggaagagagggtgatggcctggcaggtactttgggggtagcttaggccatggcctgggaatgggggacactcactttcagaggtgcttttcctggtacatgcatggcccaagattggggtgtgcaggccctcagggttccaggcttggaaacaccgaaacccaagtgacaggctgagagtcttcgagatccagggttgctaatgtgacccagtttggaagtggccctgaagtccacggtgtgagtgtatggtgtaggaagaaaggcatcagggctaggggcatagctgaacggtagaatcggatcagggattttgctggagagtgcaagcattcaaacactgaggttttggtggagccctggagtccagagtcaacggacctgggatgtgatgtgaggagcaagtaaaccgagagaggaatgctattgagaagtgtgctctgtccgagcctaggaagcacagcattaagtagtatcagatttaaagtgacaaaatctgatataggaagcattttaggggacattttcggacttgggaagtgtattaatagaacagttatacattattgagtctcaggaccatacaagtagttttgagatgttgtatatgaaatttgctgctctaggaaggatacaggtcatggctgagtttccaaagccacattagcaaatattaggtagttggtagttatttgttgagtaaatattgttaggttcccctttaagggaaagggagctagccagaaattttcggtcttggtttatttccttgtatatgtgcctaaaaagtatacccattcccatgtgtactttgaattttttgtttgttttttcaaataagcagctccaaaccaaaaaaaagcccatgcatagcttcttaaggaacaggacttgtcaacactttctggttcatattcaaaaagtttttattccaatccagagtcgttccagtcaacttgttgggaatatgttcttttccactgaatctgaatcgtagttacttgtattgctttacatttgctcgtcccagtgtgtgagggccatggaaacacatttatgttaaacatctgtgttttcctaatttgtttttccttgtttttgttaggtagtcctttttagctttagatggtactcttctgttttcataccaatttcaagaaactcctagggttttcaaatttagttttatgtgaatgcaactacattttctggagaagggaattgataagtagcagaggaagagaattgctattttggggcatattttaactccaataggtaggcattatcgtccccatattgcagatgaggaaactgaggatcagagagtttaagtagcttgtctggtgtcactcagtaagtggttgagctagaattcaaaccctggttgcctgatgccaaagcctgtaattttatctgctacatcagctatcaacataaacctgactaatgaaacttccagataattttgtatttccaagtggatcatctactttgatttctgggtgtttagagtgtataaaatggaagactataattcttaagaatttcttgtgctgcttaaggattcagaccacagaattgtaaccatagagaatatgggttcttcagctaggtattcaaatcatatcccttggcttctattgtgaaagggaagatttaccaagtaaattgctgcattttttcctgaatccaggtagataatggggaaaaatatgtacagaaacttgaagaatctgcattccttaaaaccaagcttcagaatattgcagatagtctttctgtatgtggaggtaatttatgccaaatggcgaggaactaccaagtgcctagtgtaaagagctcactggagaggtttttcaagcatcaccagttccttagggtgtccccaaataccaggacctattcaaaggcctagtgctttcttcagactgtgggatattgattctaggatatgcttatcctgaacaatgtgtaaaattaagactggataggacaaaatatttgcagttccaattttgcatggaaacctttaaatcagggtttgagaggagaccagtgagttggaaatcttaattgctttatgtcttgatgtgcttaggtgaagccctccctcatttttgtttacaataacgtttcactgtggaagatagaggcaaagctacaagtgaaaatagggtttgccatgtattttgtacattggtcatttcagcctcatttggctcagtcatcaagttaaccaaatatgaagaatgctgtagatctataacttagtttcgtttttagtaagactagacaaggtgataaaaatgagtgtatatgtacaccttttttttttcagcaggcatttctggagcaacctgcccttcaacattggtgaccaccttcattccatgttagccccttatacccatggccaccttgttaagatctggaattgaccactctagaaatcttgaactctcaggaaatctcagtagatctgagtttatgttgaaaacttgtgaacctcagctttttcttcaggcagaaatcatactaagatttatactttataggctgtgttcatggcatcttatttaattcttatgacaaatctgttatctcatttatacttacacatttttttctttggtcagaactactagagactgggcgcagtggctcacgcctctaatcccagcgttttgggaggctgaggcaggtggtatttgaagtcaggagtttgagaccagcctcgcacacatgatgaaacaaaattacaaaaattagcctggcatggtggtgggcgcctgtaatcccagctactcggaagactgaggcaggagaattgctggaacccgggaggtagaggttgcagtgagctgagattgtgtcactgccctccagtctgggcaacacagcgagactcagtctcccaaaaaataaataaaaatcccaaaactgtactagagaagattttacaaggcatttttatccccttttattttcagagaaatgaaggcaaagcgaaatgaggattcataccacagaattgtaaacatatatgggctaaacccattctgtgctatggagctatgctgggagtcttgttttgggttttgttttgttttgttttttgagagttttactctgtcactcaggctggagttgcagtggtgtgatcttggcttactgcaacctctgtctcccgggttcaagcgattctcctgcctcagcctcccgagtagctgggattacaggtgtgcaccacaacacccagctaatttttgtatttttagtagacacgggcttccaccatgttagccaggctggtcttcaactcctgacctcaggtgatccacccacctcggcctcccaaagtgctgggattataggcgtgagccaccgtgcccagccaggctatgctgggtgtctttttgaggtaattttgaaatttatatcttttagttcaaaagtactgagccactaggatctgtgaatcaaacacagggataatatagttactacttttattgagtgcttgcttacattgtaccagctgggatataaatgtattatgtatatttattctcatacactatgaggtagataatatagccaccctcatttttacgtgtgaggaaactgaaaagtaatttgcttaagttctcacagccagtaagtagcagagcccagattcagacacggatttgtaattctgttttttttttttttttgagatagagtctcgcactgtttccccagactggagtgcaatggcgcgatcttggctcactgcaacctctgcctcccaggttcaagcgattctcttgcctcagcctcctgagtagctgggattatagacgcccgccaccatgcctggctaattttttgtatttttagtagagacggggtttcactgtgttggccaggctggtctcaaactcctgacctcgtgatccgccctcttcggcctcctgaagtggtgggattacaggtgttagccacagtgctcagccacagatttgtaattcttaattcttatgtaaatgaagcccttactcttaaacactgtgttgacaccatagaatgttatgggaaaagaaaaaaagtcctggcttcttagctcaggaagcgaacttcagttctttcaggcgtgtcctttgtactgaggctccaaaagagtgagatgaccttgacagggtcacttggctatgcaagggcagagccaaatcttgcccagatcactggatttccagataggtgctcattccactggatagcattgcctctcctgtggacgcattgacttgatggcagagatgactttaagtgacaggtttacttcattcaccggaatgagaatggcagaggacattactagggtcacaaatgaccttcttaaggtcaatcctggcctcaggcatacaaccaggaagaatattcctttgccagtaagttgttcttttccattctgtttcttgttctcagaggaaactggttgtgagttatctgatgtcttacagtctttcttttcattttgtttattcagtttttcatgcatgcactgtcacagtttaggaaggctacaaggtcattttagtgttttcctgcagagactcaaagcactcaatataatgtaagtagattaattgcaggaggaaatggatttttaaaactttggccaaaaagtgcctatgggagaggacagtattagttgctgattggagtcagaccaagggaagagttctgtctctgcagtgcatttaccctctgtgctggagcaggttcttaacttgtttcttcttctgtaaaataacgacaataatacctacctgtagggtaattatgagaaatgaatataatagcgtgtggtagatgcctatcacttagtggaccttaataagtgggagaacacattttcattttggaacagcatgaaatctgtcctttcagcccgttacagcttccttgatgaggaggggtgaggccttttgtaattgtctgctctgcaatatacagtaagatttccaaatgggagagcaaccacttgacatgaagtaacctaatttagttgtgctgttgtggtttaggagctgattttcagtggaccagtgtgaggtcagtcttacttttgaatgcacaaagtagtaggatcatttgtttcagggaaagattgtttcctgatctcttttgttcatccccaagtgttgagtggtaatgattgcgatgcgatgaaaacttcttcatatttgacaaatagcaatgatgattaaattcggaacaactggtgttttcattctgaccagaaggagagatttccattatagtcatttaaaatttttctaactgtacaaattatcagttgaagtaggaccgttggtttggtttgtgtgatttgtagtcacttgagtaacgttttctttgaagtaagcagttagacagtattgtggaatggttcaggaaaaatctctctgcctgcagaaaattttgctaggttgcaggaattgttgcacccttcccacacttctccatgtgttagcagtgatgtacctgatagcagtgagacagcacctgtactcattttcagtattggagttgtattttccattttgttattttcagatctccagatagattacttctacatccagtacttcatgagagctttctattgtataaacttgtagtttaaagagtggaactagagtctaatctttgcatttgaatgtttccagtagaatacgtttaaaataaaggttgaaatatccatgtctggtcaggcacagtggctcacgcctgtaatcccagcactttgggaggacgaggctggcagatcacctgaagtcaagagtttgtgaccagcctggccaatatggtgaaactccgtttctactaaaaatacaaaaattagccaggcatggtggcaggcacctgtagtcccagctactcaggaggctgaggcaggagaatcgctcgaacccagaggcggaggctgcagtgagctgagatcatgcccctgcactccagcctgggtgacagaacgggattccctctttgaaaaaaaaaaaaaaattcacgttcaaggtactatatataaggtgtcctatttaaatgaatgccattcattcatttatttatttgctggagtcttgctctgtcgcccaggctggagtgcagtgacatgacctcggctcactgcaacctctgccttttgggttcagacgattctcctgcctcagcctcctgagtagcttgggactacaggtgcgtgccaccacacctggctaatttttgtatattttgtagagacagggtctcatcttgttggccaggctggtcacgaactgctgacctcaggtgatctgcctgcctcagcctccactgcgcccagcctgaatacccttcatttaaagccaatagtatatcctttgcctcccgggttcaagtgttaaagtcaattgtatattcttaataagattcaataattgtcctattcttaaatacattcatgagtatgaaccataaatagtgatcttgagcagtgtttcaaagtgttttaataagaggaatgagatgggccgggcgccgtggctcacacctgtaatcccagcactttgggaggctgaggcgggcagatcatgaggtcaggagtttaagaccagcctggccaacatggtgaaatcccatctctactaaagatacaaaaaattagctgggcgtggtggtgggcctctgtaaccccagctactcgggaggctgaggcaggagaatcgcttgaatccgggaggcagaggttgcagtgagccgagatcgcgcctctattgcactccagccttgacgacagggtgagactgtctccaaaaaaaaacaaaacaaaaccaaaaaaggaatgagatgactcataggaaatgatgttagagtatagaatattttgtatcatgtcattggcttaaatctgaagtactgaaggttttcacaatcccaaattactgttgcccttggcctccagagctgtaaactgtccagtaatctctatgaagttgagattctttgcccagtgttaagaagatatatccctttgacactggcatgatctgttccttttaaaagagaagagagaaggggctaataaagtacacattatctgcacagttgacatccttgtcattttaaactgttttaaaaattattactgtaccctgaaagtaagtagcatagaatttgctcattatgaaatgacgaagttggggccttttaagaagccaagaatgcttggttggcaatcacttaggaggcaaaggattgctatttatggtggtatttaatgtcattttcagtagtactaagttagaaaggaaaacgccataatgtgtgtaaaactctaaccattttggaaggttatcagaatacagttgcctatagtcttttcactccactaaaatttgtaagttggtttagagtagcatttcccaagctcttccactgaacattagttctgtgtagtgctaatcagtgtcctttggggataaaaagaggatccttgacaaaaaatggccaaagtgaaatgcctttctttactgcagaattattattcagagccttggtgcttatttgcctatgacccttcaagagggaagatacattacgcggtgttactcagacttacttggtcatggaccgctgtttgtgagaacacctaataaacgtttcatgctatgactggtgtgtagtggagcccagttgagcagttctggtgtagtctatgaataaaaaaatgaatcattttgtataagatagcttggtaatcgtgggaaaggacttttctgagaacaagatacatcttcaaggtaacgtagactcttaaggatgaatgtgatttcaaaggtcatctaatccaatgcccaataacaataataatagtagcaggtaccattttttgagtacatgctttttatcaagcacagtgttgttattctacatgccttattaaccactgggtcttagtgatttttgaatcttctttattttttattttactttaattaatttttttgagatggggtctcactttcttgcccacgctggagtgaggtggtgtgatcatagctcaatgcaacctcaaacttctgggttcaagtcatcctcttgcctcagcttcctgagtagctgggactacagggatgtagtaccatgcctgcccagctaatttttttattgttagtagtgaggaggtcttgctatgttgtccaggctagtcccaaattcttcagttcaagtgatcctcccaccttggcctcccagagtgttgggattacaggtgtaagctaccgtacctggcttattttttattttttgagatggagtctcactctatgaggttcaaggctggtcttgaattcaaaaaaatttgttttattttttaatttttaataaactaataaatggacgttaaggagatgacaaattctgaattatttgctttgttgtccaggctggtcttgaactcagtgtcttcactactgcatccagtcaccagataactttagcatcctgttttccacgttagtggtctagagtgctgccatcctcccactgtgtccccttctccagcttattctccacactgtacccaatggtaaggaactaaacagtcttaaacatggggctgggaaaatcagaattacactttaaacgtgggactgattgtgccagtccaatgtttaagacgcattagttccttatcattgtccttagaataaagttttagtatattagctttgtccaaccctgtatacctttcttttttttgagagagagtctcgccctgtcacccaggctggagtgcattggtgcaatcttggctcactgcaacctctgcctcctgggtacaagggattctcctgcctccaagggattctcctgcctcagcctcctgagtagctgggattacaggtgcctgccaccatgcctggctaatttttgtattttagtagagatggggtttcaccacgttggccaggctggtctcaaactcctgacttcagttggcctcccaaagtgctgggattaaaggcatgagccactgcgcccggcctacctttctaactctacttctagcttcttgcttctgggctgctgctataccaaacaggaatgtaatactttctgtcagcttcaggcctttgcacatgcagttcactttgtctatcttggtttttattcttaggattttaattctcctaagaagctttctctgaccagcctaaaacttacgtaagccctgggttaggtgctatgcttatgtcctcccatagcattttgcatttgcatgtgttgtaactcttaatgtacagcatcatgattgcctattttaactttcctgtttgttacagtagactttaatctctttaaggacaggaactgtgtcttgtttagaatccccagagcttatttagtacaatggctatgcttataatttaagtatttattgaacaaatgaaattttcctaagccctaaaaccttgcaagatgttttagtgcaggaaactggcctcgatggagttgaataactagcacgaggtcactcacctaaaaagtggtgaggagggattaaaatctaaatctgtttagctgtaaagattgggctttttttcttgctgctgcacatgactgctctctctcatgttgcctttacacatccctgtcaagtgttcaaacagcccgtgcctaacaaccccatccatagcttctgaggaaagttgtgtcatctttggacagctctgagagctgaagcgagtctttgcagaataatttcccatctattggtcttaatttatgctttggagaatataacttattttcaaaaaacaaataattcagaatttgtcatctccttaaggtccatttattagtttatttcattccttcattcactgataaccatttactgagcaccagtgcaatgttcctttattctaatgacgtggtcattgctcagaatgtttctgggccttttttggggattatcttcagaacttttttttttttttttttcgagagggagtctctctttgtcacccaggctggagtgcagtggcgtgatcttggctcactgtaacctccgcctaccaggtttaagcgattctcctgcctcagcctcccgagtagctgggactacaggtgtgtgccaccaaatctagctaattttttgtatttttagtagtggtggggtttcaccatgttagccaggatgatctggatcccctgacctcgtgatctacctgcctcggcctcccaaagtgctgggattacaggtgtgaaccaccgcacccggcctatcttcagaacttctatcagattattttgaagatgtgtgaacatatttttgtttgtttgttaaaccttgaaggtggattggatttgagaaatagctactagttgttcaagaccaagttgggtgagagataatgggtcagaaattataatctggcagtcctcaattttctttgatttgcttataatgttttttgagatggagtctcactctgttgcccaggccggagtgcagtggcatgatctcggctcactgcatcctccacctcccaggttcaagcgattctgctgccccagcctcccgagtagctgggattacaggcatgtaccagcacgcccagctactttttgtatttttagtggagacggggtttccccatgttggccaggctggtcttgaactcctgacctcaggtgatccacccacctcggcctcccaaagtgttgggattacaggcatgagccaccacgcctggcctatgttttgttttttttaaaacttgaactgaaacttaaaatagaaagatttgacattaaaacagtctgtcttttacttcttaaagaatctgggctgggtgcagtggctcacacatacaatcccagcatcttgggaggttgaggtgggaggatcacttgagcccaggagtttgaaaccagcctgggcaatatggggagaccctgtctctacaaaaaaaaattaaaaattagctgggtgtggtagcgcatgcctgtgctcctagttattcagaaggctgaggcaggaggatcacttgagcccaggaggtcaaggctgcagtgagctgtgatcatgccactgtactccagcctgggcaattagccctaaaaaaaaaaaaaagaatatgaagctcttattgcagttaaccacatttcctacatggccctcttcagttggagctgtgtagtggtcactcctttagatgagtcacacacttgccagttttcctcaatccctgctactccgttatttcactgacactgtggctaaaatcggatttgatttatatctttatgctttggggatatatgtagataaaaataaagacacttgctgccttcaagaagcccttctttggtaatagaggcatgttaaaaaatagttatgtgtacctgctgtataatcaagtgtatatttagatattaattgggcacctaccacattccagataatatgttgagtgctttcacttatttaagcctcaacactcctgttagttggtgttattgcctccattttacacaggaggaagtgagctcagaaatggttaagtatcttggccaatatgcagctagtaagcaggtagctatgattcagaaatcattctcccaaccaagagcaaaattctcactttaccttctttgagagtattaaagcttcaaccgtgtaaccagagttactggttttgtctcatagtgatttaagtgttttttttttttttggagacagctctgtctcccaggctggagtgcagtggcgcgatctctgctcactgcaacctccacctcccaggttcaagcagttcccctgctgcagcctcttgggtagctgggactacaggcgcccgccaccacgcccggctaattttttgtattgttagtagagacggggtttcaccgtgttagccaggatggtctcgatctcctgaattcgtgatctgcccccctcagcctcccaaagtgctggtattacaggcgtgagccacagcgcccagcctgatttgagtgttttttagggtaagaagatgcagttgtctggtgtagagggctgctgagatccaggaccagggaagaatgttagctgaaatcctagagattctgttaggttctcagtccacagtaatgacaggtagaagagaaagctatagtaagagtgaatggattcagctgccaaatggaattcaagaataatttgggttctcttcccactgtggcttgaattctaaggtaagtgttgatgagaagtaggacttgaggtcttttccttgcaaactgccaagaagtaataaaaactacgctgaagaccttcatagagtgttaaaggtcatgattgggttaatctggtacatccaaagcagagtcggagggccagcttttggaacagtgatcagacatttggtgggattagtggtgaaaaacctgggtttccagcataaaaagtggagaattttatggctcctggtagtcttcccatactgtcctttatggctaaggagttgctttctgcaggcctgcagaatatgctagagatagaagagaggtgtttcttcaaagtggcttcagggccttaagcaggtcttctccctttctgaaccttaaccgtctataaatcaaggaagttgaattggatgacatttaatactttccattttttcaatgcttattcaggcatagtacaatatgctttacatatattaccttgtttaatccttaaaatggctctctggtatacatggtgatatctatacattacagataaggaaactgaggctcagggttagtacagtgtcatataattaataagtagagtcagaacttgaaactaacactgccttccaagtgcttagttgttttgccatactggcactaattagtaatcagcgaggttgtgaacatgttctccctattcttctgctccccacccccacccttcacatgagctgcttttccttgtcagctgactggccctcaggtgttctggggctaagagaagctccagtacagataaggcctgttggccttctgccttctcttcccaggatgggagtagctattcagaatctgtaatctaaacttttgagaaaagaattacagtacctataacacatcgtgttaacataaccaaactctttatttggatgccattgtgaaattgtctcacaaccccttcaaattttaacagtgtactcttgttaatgatttacctagttgtttcatgctcttataaatgtggtttgttactggttaaatggtcctaataatttagtagtaaaatttgtaacaatttatagggtgatatttggtcataccattggctaggtctctaactggcatatcaaatttaacattagtcagatttttaaattttaatatttatttatttatttacttgaggtagagtctcactctgtcgcccaggctggagggcagtgggatgatcacggctcattgcagccttgacctcctgggtcaagtgatcctctggtctcagcttccaaagtaagtgggaccacaggcgtgtgccaccacacctagctaatttttgtattttttatagagatggggtctcactatgttacccaggctggtctcaaatgcctgagctcaagtgatcctccttccttggcctcccaaaatgctgggattacaggtgtgagccaacacgcctggcccagatttttaatttttaaatttgttgaagttggataatggtttatgctatctacacatatatatggcacctaagaatttccatggatgtgccctgaggtgctccatgtcttggtaagcagtgtggtgcagcggaaagagtaccactctcggtgggacccaagtttgaatccagatgtatggctagggaccagtttttgtaacttctttgaacctcactctttctcactggtagaagggtattgtagtgagaattagaggggtaaagtctgtaatatacctagcacagaacctggcactagtaggtgttcagaaatcatttcatttcatcatgggaaatgagtggaatgtagagaagttaatatggcagagtgatagggcagaccaccttgctcctatttcgggtccctgctgaatctctgcacatgtcaaggatgagttctcatgtatggtcaaatgaggagtttctagaaaagagctcgtctacctagcaaaacaattgtatttttcagtcctaggatatttagctttggtgggaggaagcagatctaaggagattgttaaaggcctcaggtaatgaatggtgagatgcttgtatttgaatgtgttgctaaaaaaaaataatgaaaagaaaagaaaaacatgctaattgattttcaccacattaggagctgcctcttaaaaaaccgaagcagttggtccaaaatccataagaaaatctttgactaccactggtagacttcagcaccttggaatgttttcaataaccacagtgagactagtaagaatacttataatatctcttctgagatcagctctgctgtgcttattcttaaaaatatggggccgggcgtggtggctcatgcctgtaatcccagcactttgggagaccgaggtgggtaggttttctgaggtcaggagtttgaaaccaccctggcccacatggtgaaaccctgtctctactaaaactacaaaaattagtcggatgtggtggtgggcacctgtaatcctagctactcgggaggccgaggcatgagaatcgcttgaacccaggaggcagaggttgctgcgagctgagatcgcaccgttgtactctagcctaggtgacagagggagactctgcctcaaaaaaaaaaaagaaaatttttttatatatatatggtagaaggctggggtgcagtggctcactcctgtaatcccagcacttcaggaggccgaggtaggtggatcacttgaggtcaggagttcaagaccagcctggccaccatagtcaaaccctatctctactaaaaatacaaaaattagctgggcatggtggtgggtgcctgtagtcccagctactaagtagatcacttgaacccaggaggtggaggttgcagtgagtcaagatcacgccgctgcactccagcctaggcaacagagtgagactccatctccaaaaaaaaaaaaaagagagagagagagaaaaatttatcctcgtccaggcacagtggctcacgcctgtaatcccagcacttcgggaggcaggggcaggagaatcccttcagcccagaagttcgagaccagcctgggcaacatggtgagaacccatctctaccaatttaaaaaaagaaaaaaaaaaaacaagaaaagaaagaaatagaaaaattagcgggggtggtagcacacacctgtagtcctagctactcaggaggctaaggtgggaagatcgcttgagcccaggaggcggaggctgcagtaagccgagatcgtgcctctacaccccagcaacaccccagcttcggtgacagagccagaccctatctcaaaaaaaaaaaaaaaaagaatgaaagaaataacgaatttatcctctggaatgtcaaactctgtgactgccctaaataaatcagttagtccatcaaattataatgtgcttttagtaatacatcgtcagccctctgcatctaaggatttaaccaaccatgggtcaaaaatatttttaaaaattgtgtctgtacggaacatatgcagactttttttcttgtcattattccctaaacaatacagtataacaactacatatatagcatttacattttattaggtattatacataacctagcgattatttaaagtatggaggaagctgggcaaagtgacatgcacctgtagtttcacccaagttggaagctgcagtgggaagattgcttgagcccaggagtttgaggctgttgtgccctgattgtgcctgcatagctactgcattgcagcctagcaacatagtgagacaccatctcttaaaaacaagtatacatgggaatgtgcaagtgttttatgcaaatactataccattttatattagggacatgagcacccaaggattttggtatccatgagagggttggctggggagtatcctggaaccagtctcccatggataccaggggatgattgtattcactaatgttctagcttttttgtcattccccccaaccccttatcattatatttccttcttaggttcctggttgactttctagaaatgccacttccattgtccctgccgctaacttcatacattaccttaaaattttcctatttaaattagtttgtgttttaaaataaagtgctttgccttgataccagtctgtgcctttaaagtgccactaacataatgacagatgccttttagaaatcatgcaaactattgtatggccattggcatcactctgttagtgttaaagaagctgtattttctttggattagccctacccagttttgtttttcttctgttaatgctcaacagaaaactgaagatggtcacaactttccgaccttgtgcacattgcttctctggtctattgccataggataccgtagcagtatcttacagacatctttgatggccaatcagaagcagttaaattaccttaaattttttaaatggaactctgacagccaataagaaatcccgtgggtgggaacactaacaaccctttggcttgtttttaagaacaattctaaattttcaatattctgttttagaagcacatgatgccctagtgcagctgctatgtgcatttgccagacatttccacgccttagagttccccatagtttgaagtctgaatctgacccctgttctgcttctcaaggtaactttaaaacaggaagtgtacaaaagaggtaactgatgacgtgaacagccaatcgtggctttgtgttcttagccgataaagcagttcagccaatgggaccactgtggaggcaaggtttggtgtcaaatagcatgctagattgaatgcctttgactgttaaagtggaaggaggctgcagggcttcattggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttgtttcctccgtcctttggggggtagggataggagtgacttaaattctcccagtcggtggaggtataaataactacatgtaaaattaatgcagttcccggtaagtttaattctttgttttgtgttgaaatgatagaaactgtttagcttcagagagtgtagacaagttgcactgttcagaaaatggccactttacattccatgcataccttttggtgcacctagaataccttgctgtgtttagattttgcatgtccttcaactaggatttctttcctagttgggtatcgacaagatcaggtacatggagaaaggctaatcatttttcaggggcacacagaagcaaaacacttttctctttgcattgggtaaacttaactgttttccaaataattttcctttgttcaagtgccctgaagctttcctacggaataagctgggttgttgtgagagtttttctatttccatgcactttgttgacatctgtgttttcagatatggaagcaacactgttgctgttagaaatttgtgtgaaaatacgatttgcactgctgcaggttctaatggtgaaggcccacatgccagtgtgaaattttcccataactttcttgatttaccagtctacctctagattctaataagtagtagttaatgtagtaacaatctttgtttttaatgcacattttagcttagaatgctggttagaaatatcttcacttatattgacagtgatgagcaaatatttttccacagatttcacacattttgtcaggtgttgatttagttctttaaaatgatgtgagcaaagtgctttccatttttccgtattaaatatttaaaatcctgcagtttgtgaataggaaagttaagagtataggcaccctatcttttgcccttgatatgtatatatttttctctttatggatataaagctaatgtaggttgctaatcagtaaccagccagttctcatgaacagtgaaatcttcaatcccacatactaagatctataatacacctgattttaaaatgcaattctttgttttctttttatttgcaaatatggaatgaaggtcattggaacatttctgcagcagactcagtgtggagccgtcagccagcagcacttagtctctgggtacggaaaaggagcaggccctattagaggagaagtttcgagggtgtcgatttgccttccctagcttcccctctaataaaggatttaccttagaggactgataggatttagattcggggctcttggagttgtaatgatatagcaagtcaaagttcctggatgcaggcctctgtcgttgcttgcaaaagtgaccttgaaaaactgctggggagttgaaagattgaaggacaaagtttgtttatacagatttggactgaaaagctctatttaagatgaaaagagactgtacttctgatattcaagtcgagtggttagtaggaatatgttatagattcagattaggaattttcagggaataagacaatagggctgcattcattctctctcccactctttttacttccctccccccagcaaaaaattctaaattcttttggtatgatagctgagtgaactgcctaacagattcagaattccttgcatgctaccttgtcttctttgtaatctagagggttcttagtgaaggggatagatagtattttaggagttcagagtagttgtatttgtgaaagttttggggaattagaatgcttataataagaaaatgttcattctgggaatttaagtcctaagatgaagaagtatgtgttaaggattacattttaagaggtagttattttgatttaaatttatttgtttgtcattgattatttatatgttatcagttgttccagattatatatatgattttaaaaacagttgtaggtgctgacttgaccctgttggccctaggagaaggcctgcagcaggggaggcaaaagtgaaggtgtggtacagtatgaagtaaactataaacttgagaactttgtggatttggcttcttggaaagatgcccagtcactgcctctagccgaggttcttcaccattctctttgagaatgacccactacctggaaaaatgcacatgggcatgcctgtacaaaacctttgatgactaagttattttttagtgtatgtcaaatggtatttaacacttcagccagataaatgtttactagacaaatgaagaaaactttgcttccagaaagagcaaagaccttctagagagctaactctaatttaggccatgggtggctgtgtgtgtaagtgggggaggcttagatggggtctagagatatggacatttatttactctgatcacagtatttgaggcagcatggtacagaccatttaaagtcaagagatctgtgttcaagccccactcacctttatcaccagctttgtaggtttgggcaagtcagctatttagtgttagcttcctcacatgtaaaaatggaacctaaaaatagtgtctgatttagtggcgagtcttgaatgagatcatgtgtgtcaaagtactttgcaaattgtgaagagctacataatattagttgttactaatccagactatttgggggatgaaacgtttatgaagataggtgtggcatcaaagaaaaaaatgccagtattttaatatttgtaaaaaggagttagtttaaacctgacacatttctttttaaactgccttcacctgcatattcctatttatgctgacatgaccctatttatttaatgcatatgttgagaccaccagtcctttactcatcaagatccttgtgaaagaattttaacccctttgtcaaaatttaaggacctctcagaataggatgaaatgggtatgctgatttttaaaaaactcttgttagatttaggaacctctcagaataaaatctggaagcctgttccatttgcattatgagatttgcattacaatgcaggtaagttgtaatggttgcagatgtttaccaagcagaggttacatatttagtttgtataccaaatatttataaagtaaactggaaccatttttttttttgtttgctttgtgattatcctgtcaattttcaagcatgggaggtaattatagcctgctgtatagtaagcaagtaaatgttgggattaatgccttttttttttttttttttttttttgcagacgaggtctcgctctgttgccaaggctggtgtgccaggctggagtgccgtggcatgatcatgactcactgcagcctccacctcctgggctcaagcaatcctcctacttcagcctcctgagtagctgggactacaggcatgtgccaccgtgcccaactaatttttttttatttatttatttttatttttatttttaaatacagacggggtcttgatttgttgcccaggctgatctcaaactcctggactcaagtgatcctcctgccttggcctcccaaagtgctgggattacaagcactgggattacaggcatgagccattgtgcccaattgtgggatgaacactttaaaaaaaaataattgatctctcatcagaaatctaacataaatttcacacagttgatacctactatgagatacctttctaacataattggtggaaactcatgggggtttcttttaatctagtctgcatgcccagtgtcatctatttttaggacttccttttttcccccccaggggtggggttgatattttgtgatgtttgatttcctgtcctattaagtcacttcctctcaggcatggtcagtcagcattggtgtctgcttcctatctgtgcattggaagaatcatattcagacagaatgaggtttggcaaaattgatactgactttaccaaataaaattccagttccagggatgtgtaggtttaaaaacagcaatcgtggtcactttgggcttttgtttttaaaacaagatgaggtctcccttttaaagaggctaaatacttttgtaggagcttcagtaacccaaaaaatgtattaaaagttgaacatggctgtcttcatgaatggaatgatttttgcctatccttattactgataatatatgcatacagagtttgaatacatctaaattaggctgatgggaatcacttagggatctagtctagttcccttcttgtaaagtggggaaattgaggcccagtaagttcaggtgccctaatccaagtctttcagctttttaggaacaggcttgtacaagtttggagatttgactcccactcaatttgttgcatgtttcttttattcctctaggttgttttcactttttatttttcatgtttcttttctttttgggacttctgtataggcttgctgtttgggtatagaaggaacagagaaaatgtgccatggaagaggttcagaagtctttacctgaagtgtgttggttagaaagtctgctgcagcagatttagtgtccctttgggatctgaagataccttgcctcagccagttagttgcttattcagaaagctgagaaccagctaggaagctaatggtgttcacctgtgaggtattccagaaagccaggttacttttatgcattatgaggaatttagggtatacaaacacatcacctgcaagccagttagtgttttttgttgttgtttttttgttattatatttcaagaacaagctaattcccaaaaaagtttggacctggctcttaaagtgagtccacaagctaacctgtatttaataaacaaagattccagggtcattttaagcatttgacaagactaaaataggaatcattgtttatagacacccaaaataatatcttaactgtgctgactttactgtttcccatcagcaaagtggtattatgtgtgtatgtgcttgtgtatgtttgagtagtatttgttctttatattctttgatagaccatgatatactttaacatttttaatttttctgaaggtgatgaccttcatatatttagacaaaagttatagtccattgaaagaatgagggcttgaacgatgtaagttatgtaatatttaagtcctaaagtgtactgactgaagattataatagacatagctggatagaatatatttcatgtctacatttcccagaagtttagttttctttccttttttttggagacaaggtcttgctctgtcacccaggctagagtgtagtggtgtaatcatagatcactgcaaccttaaactcctgggctcaagcagtcctcccacctcagcctccgagtaattgggactacagatgcacgctactaggcctggctaattaaaaaaaaattttgagggcagggcgtggtggctcacgcctgtaatcccagcactttgggaggccgaggcaggcagatcacgaggtcaggagatcaagaccatcctggctaacatggttaaacctcatctctactaaaaatacaaaaaattagccgggtgtggtggcgggcgcctgtagtcccagctactcggcaggctgaggcaggagaatggcatgaatccgggaggcggagcttgcagtgagccgacatggcgccactgcactccagcctgtgcaacaaatcgagactccatgtctcaaaacaataaataaataaataaataaataaataataatttggctgggtgtggtggatcatgcctgtaatcccagcactttgggaggccaaggtgggcggatcacttgaggtcaggagtttgagaccagcctggccaacatggtgaaacccagcctttactaaaaaaacaccgaaattagccaggcgtagtcccagctatacaggaggctgaggcacaagaattgcttgaactgggaggttgcagtgagccatgatagtgccactgcactccagcctgggcaacagagtgagattccgtctcaagaaaaaaaaacaaaaaacaaaaactttttttttttttcctgtagaaatggagtctcattattttccctggctggtctcgaactcctggcctcaaaggatctttctacctcagcctcccaaagcactggcatttacaggtgtgagcatctgtgcctggctagttttctttttaatgtgttctgctacctccatatgggggcccacctctttataacgtggtcagattctatttgtattatcactcttatcttcttgtctctcccttagggatcccaaagctagaccccgctgttcaataattgaccaaaagtttttctctacttatagtattttttctaaattagattacagtctagcacctgcagtgaaaatgggcaatcgaaggataaggaatgaaggtaaattccagtataaaggaagaactaaagaaaaaaaaacatagtaaatgtttaactttaaagtggcataacattgtgaccttgtgttccttagttcaaagaaagaagactaaaataactacagcaaatagcagtgctaattcacttggttatcctttcttcttggaagtactaccgttttggtctgtttccatagtttcaattacatagaaaactaaagggaagacctgctcaattgaaaatatccagataaaatgaaattttcttctgtctacctaagctatatagttcttactttcaaggaaatgctaaagttggatgctttttacacttcctttcatcaattcaccacgcatgcatgtcttttttgtggagactttaaaaatgtatacaaataaaattttactctgagactgatgatgtttatcaagtattagaaactgatatggaaagaacaagcaaaatacacagaattcagaggaggggagacgttcgcttaggaatgaaggcaagctgtttaactgggtgtagactcagggaggtagggacaagggcattccagacattgggagcaacaagcaagatcatgattcaaaaagtacatcttgggttaaggagagcagtaaatggtcaactgcttagagcataaggagatgagttaaggacaggaaggagtggtaaaagaaagaagtatggagaagtagattgggtcagatgttgaagggccttgtttgctaggctaagaaatttgaacagtctctgcttgacgttggtgaccattgaaaatctggggtagtagagtgatgtggcattatgagagctgcacttttatatgatttattatacatcttaggttcacaacccttataggattattaggaggtttaaaataggtagtaacataaagggcttagaattgtacgtggcacacagtaactcctaatgaacattggctatcatcatcatcgtttttattacatggaggcaatgagggtctgaacagagatagtggtagtatgaagaaaggtcaggagatggacactgttggacactgttactatagaatttagcagctgattagaattgaggaacagaggagaaaaagtgcaaaatgatactgagatttctatccagtctgggtgactggaggatagaaacagaaatttaggaagagcaagtttggggggaaaagaagatagatttgatttggggcacgtggaatttcagttctgggtagctttctggttgtagatgtccagccaggcagcttgtacatgaaggactgaagctttggagaaatatcaaaattggtaatgtatatttggaatttaggatcatagagattatagctgaacctaggggacaaacaggagagaatcaagaaagagaattgacagaagactagtgctacatgtcaaacatggaagcccaaaaatgtctgactctaaagttgagaaatccagaaatgagcatggtagagtcctctaggtcagtgctctctaagctttttttggttgcacacccctgttttctgagtgtgcatttcccatgtaagaattaatattctttattccaaaaagttacttgcttggttttttagtattagtttactaaaaatagagaatatctgtaactccccttaatccaggcgtgtacaacaaggtaaaggtttcattgttagcctacatcttcctcgcagtccttggagcaccgtatgtaatacatggtcttctgacaagttcaactaaatgagggcatcattatcagctcataggttaaatatttgaaaagctaatattaacactttctgtgtgtgccttgataagtaaaagactagaaatacttccttagaatctggtgaccttcacttgctttaaagatgtacaaatatttccttgagattagtacatataccatatctccatttggtacaaagactaggttttattttttgagttgctttgggcataatcttactgattttagctttgtaaaatctcaaatggcagcatcctgcatgaagctgaccaaaaatacatatgtaggaatttggcagcatttgctgagcaagtaatttatagcccacatgatcattgtagcaccaatgagcagcacacacaattaattaccaggaatgagactagcctcatctgtaggatttagcagaatttttaatataagacacctatatttagtttctaggctatatatgttgtaattatcctcaatctaaaataaaggcaataagaaacttttcactagagaaatagtggtaaatttccagccattttacctcattatttataatctaaactccatgattattttcctcttggaaattcattggccagatgcccatgaagctccccttgaaggtggttaagcaatgtaatagaatgcagtgtttatatgaatagtactttatagttagtgaagtgatttcatactcattctcttatttggtatctacctaatgtaagtaggacagacgattatcatcccccattttgagggtgagaaaatagaaggcagagcctagtgacaaaggcttttgctctttatactgcactttcttaccatatatgaaaaacagtctatagctgtgtccatcttcggggactaattcttcctcctaccttctcttttccatacttgcttctcccctgaaaggcacagaactttcccagagttctcatcaactctcatattatagactgcttaacaggctaatcgtaaagggaacaaacatacagtcaaattgaattacctttaaagtgtttgttaaaataggtgaacacggtcactttttggaacaaagcatggtacaagtagataacaattgagcactaccagtattttggaaattgtctttaatgaatcctaaattcactaaggtcaggtaagtagttgaaggattttttccaaatagatatgtggttagaattgtattaggtattctatggtattccttagctatgcagatacatactttgtggtatgtattgaggcagctcccacatttgggttctcatcttgaaacatagagatcgatatttttagatgaatcatggtggttttttttgttttgttttgttttgttttgtttttgagacggagtcttgctctgtcgccaggctggagtgcagtggcacgatcttggctcactgcaacctctgcctcccaggttcaagcgattctcctgcctcagcctcccgagtagctgggactacagatgtgcgccaccacgcccagctaatttttgtatttttagtagagacggggtttcaccatgttggccagatggtcttgatcttatgacctcgtgatctgcccgcctcagcctcccaaagtgctgggattacaggcgtgagccacggcgcctggcccatggtgttcttaaataatccgttgctttaaatttcctagctatgatttataatccttgcttacccctagtgaggtggaacaaaggaattctgatttcttggaggaatggctggataattaaaataacattatcaccatgttcacaatgtagcgatagctataattttgaaacactgcatagaatttagccaggtgattcctcctataagtgggcagctatgaaaacatctccaatataggaggctgggctaaggctcttcttctgaattatagagaaaggatagagtgacttcccatcaccaggcccccagaaagtgaacttgatcctttctatctccacttttgtttggtagctagatggcctagtcccactcctttgatgcaactgcagtttagcaagcttgaaaaccttaagctttcttgtttaagctttctactttgaaatgtttaagaatctggtatcttgatttttttggagtacttttttcaggagagtgatcaggaaaacgaaaggtaaaaaggcctggtggatttgtgttccaggctgagaaaagctataggttcttaagttttgtgttttctgttgttatcaattctaaagtagaaggagaagatttaatgaaagagcacagaactgagaatcagaagacatgaattttaatttcacctgtggcatatacttgtcctggtgaattctgccaagttcctcagtccacctggataaagtatctttatctgtcagatgtgttgcttatcttatgtgtttatggtgagaaacacataaaataacatgaaactactttaagaagtgtaaagtatgtacaaatgtaagggattagcataactatctcagtcactttgccctctttgaagaggtctttatgttctcagttcctgacagctgtatacatgaagttaagagatttatggtttggttggcttggaagatttgtctcatttcatgtcgttttcctttctttcttctcctcttttaaacatttaaatcaataaaagacactaaacagagggaagaattcacagtgtatctgaatgagcagaatctagacagcagaatcaatacagccaagctcatattgacattattataacgccctctaggtttttaattgacaattttctgccttcccctgtcccaccacccccctggtttttagatgtattaagtcaccagcacaatctcccatttttcagtggagccgatgattagataattgtctacattttccaaagtagaacaagtttttctccaaccccactcttgtggctcttccattggattactgcacaaaggttactgcacaactgagcacagatacttaagaaggaattttcccatttcaaagaaaagtacctagaatgaggccaaggatacttggggtcttaaaatagttcttgtccaggcatggtggctcacatctgtaatcccagcactttggcaggccaaagtgagaggatcacttgagcccaggagtttgagaccagcctgggcaagatagcaagaccctgtctttacaaaaaattttaaaaattagccaggtatggtggcaagcacctgtagtccccgctactcaggaggctgagcaggggaggatcacttgaacccaggaggttgaggcttcagtgagccatgattacgccactgcactccagcgtgggcaacagagcaagacactgttatttaaaaaaaatttttttttaagttcttgaggaacctgtgtttgttcattcagtagatgtgtattgaatccccactatgtgcaaggcatatttgccttgagggtgtatcagaaacaaaatgattatgtttgtcttacaaacgggggaaaaaataggagcatgaaaaatttaagcttaaaaaataatatgccccctaaaaaaagagaacatgttacacaagtctgaagcaagtgaatatgctaattagagaaatagatttgattgtgtgccaggaatggtttcttggggagaaaaaaaatttatcatcactgattagtgaatgtgtagacagtgtttaatttctttacatttgtactgtaaaggcaagcttcttatcaatgctattgcagaagagccttaaacattggtttcaacccatgagatagtctgagaaattccaactttccagaacatgtttccttcatgttcacttcaggatgttggatatagatggaagtgggtggagctctctttagagctccaaacagaatcttttgcttggatggtggggccaggttgagtggggagctgcctggactccaggtttcctctaccctctaacataaacaagattcctttcacaagacaaaacaggcacgtactcctagcttgtggaagtcttaggtatccaaggagatggtggtggttgtgggtttttttggggtttttttttgatacagggtctcactctgttgccaggctgaagtgcagtagtgcaatcatggctcattgcagtctcccagctcctcggctcaagtgatcctcctgccccagcctcctgagtagcgggagctacaggtgcgtgccaccacacaggctaatttttttttcttttttgtagagacgaggtctttctatgtttcccaggctgatcttgaactcctgggctcaagcgatcctcctgctttggcttcccaaagtgctgagattacaggcatgagccaccgttcccagcccaaggagacatattctaagaattgaaggccgggcgcggtggctcatgcctgtaatcccagcactttgggaggccaaggtgggcggatcaggaggtcaggagatggagaccatcctggctaacacggtgaaaccctgtctctactaaaaatacaaaaaagttagccaggcgtggtggtgggcacctgtggtcccagctacttgggaggctgaggcaggagaatggtgtggacccgggaggcgaagcttgcagtgagccaagatcatgctactgcattccagcctgggtgacagagtgagattccatcccaaaaaatatatataaataaataattaatttaaaaaaagaatttaaatgtttttggattagtgtggagagaaaacctagtatagctattgatcattgacacacccaaggatttaaatttggaacgttcccatgttcagcttgaattctttgcttttttggaactagtacatttgttccaaatttaatagtttaaagggcttaaaaattatttcatgtttataaaagagataggagaacatctttctctattttaatatgtatttccatgcatctgaaactaggctttttaaagaaatatgtcaaaagcaaagtaagtctaaattatagagaaaaagaagctagttggtctttaggctcggtactgtatctgggactcttcagaccagtagttggtgtcttgtctagcttcaggcagccatgatgatatgatgccatctggcatttgtatgaagcttgctattttttgaggccttctaacatgtgttttaccatttgtgtgtttcagctgctctgtgggatgttgctttagatgaatagagaagtttctaagaagttaagagatttgctcaagatcacagttcgccagagagctaagaacccccaggtccaatacattttatttatttatgtatttacctcgtgctttagtgcccccaactgttcgcagctgagtattcataggtgctgctaacctgcctagagacatgcaaaggggaaggataaaacagaaaagaaaaaagagtgacagcttaaacagtgcaaaaagtgggaaagagcaagttataataaatcaagacagaattttagagcttttgcattttgactcatcatttattgtattgtgatcttgagcaagtaatttgatattcaaccctcaaccttatctgtaaaattggaataatattggtaaatttatcactgagctaagtaagggtcaattgaggatgatgtatgtggcatgtattttatgaactctgaagcccgtaagttggcatctatgaaacattcttcagaatcacacttcttccctctgctagacacacaaacacaggatactgccagaaactgggcaagaggctgtttgtgaatctcagaaggcacccggtaagaaaatgatgctttgttttagaatacaacttaacttaggctacaggcactctttctgtctctagctcatgtcacaattccttttcgggattgaggcctgaaaaaccagttactcaccattcttcctacaaggatttatttactcgttaggctggagggtcagagagactaacagatacttctgtggggcagagggggtctggcccagcttacttctaattgaggatgaacaggtgagggaggcaggggagctaagtaacagttgtgtgatctaggaccagcttctcaacttctagtgtcagtttccccatcagtaaatcagggataaataaaacacctaacagtgctttaaaacaagatcagaatattatctgaaactttttcttttcttttcttttttttttgagacaggatcttgctctgctgttcctgctcaggctggagtgcagtggcgcaatcatggctcactgcaggcttgaccacccaggctcaagcagtcctcccgcctcagcctcgtgagtagctgggactacaggtgtgggccactacacctggctagttttttattttttattttctattgagatgggggtctcactatgttgcccaggctgatctcgagctcttgggttcaagtgatcctcccgccttggcctcccagagtgctaggattagaggcatgagctaccatgcctggctgaacctttttccttaaagggccagatattttaggctttgtggctgtatgatttttgttgtaactcttcaactctactgtttagcatgaacagacaatataaactaattaggggctggacatggtggctcacgcctgtaatcccagcgttttgggaggccgaggtgggcagatcacttaaggtcaggagttcaagaccaacctggtcaacatggtgaaacccgtctcttcaaaaatacaaaaattagctgggtgtgatggcgggtgcctataatcccagctgcttgggaggctgaggtgggagaatcgcttgaacccgggaggtggaggttgcagtgagccgagatcgtgccattgtactccagcctggatgacagactgaggctccgtctaaaagtaaatgaataaataaataaataattagggttgatgtcttccagtgaaactgtttctaaaaacaggctgtaggccagatgtggcctatgagctgtagtttttagacccttgctttagaatacttcactaaatacttgatcctttttcttcatcatacaaaatactgatagtgttttattgctgttatatatgcagagatggtttaagtttgagcattgaaaggatgagtaagaatgtgtgtgaagtaagatgttacatatcgttttctattccacagaaaaaagttttcaaatgttctgttcatgccttcccgtcactttcattgtttataccagttgctgtgccttcatttttctctagttgtgctacaactatattatgatctggcccctgtttcaaagattatattgtactagataccaaatagaaaagtatttttgtttttgaaggaaaagtggctcttctgccagtttgaaaatgtgtccttgtgtacagatctttaaggagagcagtgtgcagccacttctaagcctaagtcttttaggaagcatggttttccagtaggcactttgaaaagcggcttcctcttaacacagatataccttcaaacgtcaaacttggcattaatcagagttggggaagtagagctatgttattcattcttgtattatagtagtgaagactattcagtagcctgccagtaaatatgaccagctggtacccagctatgtaagggtttagaatgtaagtaataaggtttcaggcactaaacgtagtgcctgaacttagtttcctgcatgactatataaaaaccttagatgagtttaaatagagactattgaaccttctcttctctctagtcactttgccttcccttgtattcattcatttattgcatcttcaagtagtgaagtgtaggacttccccaccaaaccaccagagacccctttggaatgtgttcagtatacatcattgctggagtggcttagtagagtgactggcccagggccaccagctagtaggcagcaagcgtccagtacacagacgtaggtcttttaatttccagaccagtgctgtttttcttcttgtgaaattgtcaattttagattggttttattttggagagtataagccttcttaagaaatgctttttagctgttgtgatcgataatagcataagtcctaaggtccatctgtgtaaacataaaaaccaaatagtctgttagtaaataaatcctacccccctttccctcatccatccatttatttttattaatattcttcctttctctgtatctcccatcatcatttaaaatataacatcttacaaaccttagctcatttaaatgaagaaacctagaactaacctcagtaaatacctgagcagtactggtacataaaatgcttgtgatagtgctgccactagggcaaaatacaataaagctaacattataataaagagagtcacacaaatttgttggtttcccagtgcaaatagaagttatgtttatattatagtgtagcctattaagtgtgcaacagcataatgtctaaaaaatgtgcttattttaattttaaaataccttattggtaaaaatgcaaattatcatctgaacttgcagcaagtcataaccttttgctgcttgagggtcttgacttgatgatgatggctgctgactgattcgggtggtagttgctgaagtttggggtggctttggcaatttctgtgtatgtgtttgtgtgtgtgtgtgtgtgtttttttttgagatggagtttcgctcctgttgctcaggctggagtgcagtggcgccatctcagctcactgcaacctctgcctcctgggctcaagcgattctgctgccccagcttcccaagtagctgggattgcaggcccgcaccaccatgcccagctaatttttgtatttttagtagagacggggtttcaccatgttggccaggctggtttcgaactcctgacctcaggtgatccacccacctcagtctcccaaagtgctgggattacaggcgtgagccaccgcatctggcctgttttttttttttcctctctccacactgtcacccaggctggagtacagtgtcatgatcttggctgattgcaacctctgccttccaggttcaagccatcctcctacttcagcctcccaagtagctgggactacagacacgtgccaccacacccagctgatttttgtattttttgtatagacagggtctcctgtgttgcccagactgatcttgatgtctcaaactcctgggctgaagtgatcctcttgccctagcctcccaaagtgctgggattactggcgtgagccactgtgcctggctggcaatttcttaaaataaggcagcagtgaagtttgttgcttcagttgactcttcctttcatgaaagatttctctgtagctgcttttctgtttgatagcattttacccagagtagagcttctttcaaaactggagtttgtcctctcaaatcctgccactattttatgaactaagtttatataatattctaatgttcatagcattttcactgggagtaggttccatttcaaggaacgactttctttgccttccataagaagcaactcctcatctgttaaagttttatcatgagattgcagcaatccagtcacatctcaggctccgcttctaattacagttctcttgctatttctaccacatctacagttacttcttccactgaagtctcaaacccctcaaaatcatccaggaggattggaatcaacttcagactcctgttaatgtttatattttgacttcctcccatgaattttgaatggctttttttgtttgtttgtttggttggttggttggttggttggtttttgagacagggtcttactctgttgcccagactggagtgcagtagcaagatcttggctcactgcagccctgatctcccaggctcaagtgatcctcccacctcagcctcctaagtagttgggacaataagcatgtgccaccacaaccagctaatttttgtattttttgtagagacaggttttgccatgttgcccaggctggttttgaagtcctgagctaaagcagtcctcccgccttggcctcccaaactgctggaattacaggcctgaggcactgtgcctggccatgaatattcttttttttttttttttgagacaaagtcttgctctgtcgcccaggctggagtgcagtggcacgatttcggctcactgcaacctccgcctcccagattcaagtgattctcctgcctcagctttccaagtagctgggatttcaggcccacaccaccatgcccggctaatttttgtatttttttagtagagacagggtttcaccatgttggcccggctggtctcaaactcatgaccttgtgattcgcccgcctcggcctcccaaagtgctaggattacaggcatgagtcaccgcgcccagcctgccatgaatattcttaatggtatttaaaatggtgaatcctgtctagaaggttttcagtttactcagatctgtctgaggaatccctgtctatggcagctgtgtccttatgaagtgtttttatttctgagacagagtctcactctgtcacctaggctggagtgcagtggtgtgatctcggatcactgcagcctcatgctttggcctctagagtagctgggactacaggcgtgcaccaacaagccctgctaatttttgtgtttttagtagagatggggtttcattatgttggccaggatggtctcgaactcctgacctcaggtgatccttctgccttggcctcccaaagtgctgggattataggcatgagccactgtgcccggccatgtattttcttcaataataagacttgaatgttgaaattactctttggtccatgggctgcagaatggatattgtgttagcaggtgttaaaatactaatctcggctgggcgcgatggtttacacctgtaatcccaacactttgggaggctgaggcgggcggattacttgaaatcaagagtttgagaccagtctggccaacgtggcgaaaccctgtctttactaaaattacaaaaattagctgggcgtggtggcgcatgcctgccatcccagctactcgggaggctgggcatgagaatcgcttgaacccagaaggcggaggttgcagtgacctgagatggcaccactgcactccagcctgggcgacagagtgagactgtcacaaaacaaaacaaaactctgatggagttgtgcaagcagattaatgttttttgttttgttttttgagacggagtctcgctgtgctacccaggctggagtgcagtggtgcaatcttggctcactgcaacctctgcctcctgggtttaagcgattctcctgcctcagcctcttgagtagctgggattacaggtgcccgccaccacgccgagctaatttttgtatttttaatggagactgggtttcactatgttggccaggctggtctcgaactcctgacctcaggttatccgcccgccttggcctcccaaagtgttgggattacaggcgtgagccactgctcccagcctccatcagtttttggatgaccaggtatattgttagtgagcagtaatattttcaaaggaatcttttttttctgagcagtaggtctcaacagtgagcttaaatagtcaaccacgctgtaaacagatgtgctgtcatccaagctttgctccatttatagagcacaggcagagtagattttgtataattcttaagggccctagaatttttggaatggtaaatgagcatcggcttccacaggcattgacttctttgtagctatgaaagtccttgatggcatcttcttccagtaaaagtccattttgtctgcactgaaattctgttgtttaatgtagccagttgcatcaattactctagctagatcttcgggataaaacttgctgcagcttctacattagcacttgctacttcaccttatacttttatgttatggagatggcttctttgcttaaacctcatgaaccaacttttcttctgcagccccctcacctctctcagccttcatagaattgagagttagggcattgctccacattaggctttggcttaaaggaatgttgtggttggtttgatcttctgtctagaccactgaaactttcttcatatcagcaataaagctgtttgctttcttatttgtgtgttcactggaggagcacttttaatttccttcaagaactttttctttgcagtcacagcttgggtaagtgtttggtgcaagaggcctagctcttggtccatctcagctcttttttttttttttgaaccggagtcttgcactgtcgcccaggctggagtgcaatggtacgatctcagctgactgcaaccttcgcctcctgggttcaagagattcttctgcctcagcttcccaagtagctgggattacaggcgcccactaccatgcctggctaatttttgtatttttggtagagaaggggtttcatcatgttggtcagggtggtcttgaactcctgacctcaggtgatccacccgcctcggcctcccaaagtgctgggattacaggcatgagccaccgcgcccagccccatatcagcttttgatgtgctttcctcactaagcttaatcatttctagctttcgattgattgagttagagacagagttttgttctgtcacccaggctggagtgtggtggcatgatcatagctcactgctgcccaagtgatcctcccacctcagccttctgagtagctaggaccacaggtgcatgccatcagcaggactggctaatttttctttcttttcttttttttttttttttttttttggtagagatagggggtgtctctctgtgttgccaagctggtctcgaactcctggattcatgcagtcagccctccttggtgcctcaaagttctgggattacaggcgtgagccaccacacctggcctttagcttttaagtgaaagatgtgagactgttcttttacttgaacgcttagaggccgttgtagggttattaagtggcgtaatttcagtattgctgtgtctcaggtaatagggaggcccgaggtgggaatggccagttggtagagcagtatctgtgaagcacaataaagtgaaatgcaataaaacaaggtatagttgtaaaaaggatgtcacctcatgacagaggaagatatgatcaaaatgcaagtcacaaaagtgagtgaagaaggtaagtgccttgatcatagagagatacttgttgacatgttaagttggagatgcacaggaatggttgggaactcaacccaaaaagcctaagggctgcaagtcggtttggggaacattaaaggggaatgataataccaacattatatttgtttcttagtcagtactgagctaagatatatttgtttgcatttgacagtgagagcattatttttaggtaaaacatgtcttcccaggatggttcaactagtagtacagagggtcttcagacaatgttgtttgattataatattgatgaagaaaaaagaaaccagttcctggccggggtcactctctgtgtggagtttgagcattgtccccacgtctgtttggttttttttccagtactctgctttcttcttgcatcccgaatatgtgcatgttaggttaattggcacatctaaattgtctcagcctgagtgagagtgtgccctgtgattgagttgtccaggcttggttcccaccttgtgccctgaactgttgggataggcttcaatcatctgcaaccctgaactggaataattggataaataatcatcttacttttttttttgggacggagtcttgctgtatcccagtatggagtgcagtggcatgatcttggttcactgcaacctccacctcctgggttcaagcgattctcatgccttagcctcccaagtagctgggattacaggcgcctgccaccatgcctggctaatttttgtatttttagtagagacagggttttaccatgttggccaggctggtcttgaactcctgacctcaggtgatcctcctgcctcagcctcccaaagttggggttacaggtgtgagccaccgcacctggcctttctttttctttttcttttggcgggggcgggggacagagtcttgctctgttgccaggctctagtgcagtggcgcgacctcagctcactgcagcctccacctcctggattcaagcgattcccccgcctcagcctcctgagtagctgggactacaggtgtacgccaccacacccagctaattttttatatttttagtagagatggggtttcaccatgttggccaggatggtctcaatctcctgacctcgtgatctgcccacctcggcctctcaaagtgctgggtttacaggcgtgagccaccgcgcctggccccggcctttatttttcttaatctttcttcaatgtatgtatagttcatacttatttcagtgtttaatattagaagtgtcttgatctttatttagaagtttggtgatgtttttgtgaccagaaatatggaataggaactaactcttatttatgtcaattagcctttggtaaaattggttttgttatatgtttggcttaagttgcggtttccaagagcctatcgaagacattaagggaggacttaactttgctttaattggaagcagcattggtcaagaattgggtttcattttagcggagcttcctgtggtctttttcccttggacagttgttgtgatgttaggtttttaagtattatctcccaacaacatctatttagttttagttacctcaaagagctgtattgtgggtttaggctactataaaagagtttggtatagagaatgaagtacatgccaaggaatagagagctgaactgaagtctaaaggtcctgagtttcagaaaccaggtcatattgcaataaaaccttagatttctttttatttatgaggttgataattttgatacatcctgttgttccatgcccaggcatatcactaagagaagatttggcaggcatggtacctggttgagagcaagagcttgaaagatttccaaacaattttaaaaggaacactctgattttgggatgttttgaaaacttctgaagtttcatttttttctttaagaatgataaagagtaactggatataagagtaacagctagattgcccactcatcagtggtctgatcaaatcatctcacttctgcatgattttccccttcttgctaatggatggccaggcagaggtatttatcttcctcctacttacccattgtcattaatatttcagactttgctaatctatcctggtcacttttctgaagaggttctgactttgaaaagatttacacttgagaatggtatgcatccacatttccagccttcaagtctgcctttcagcttccagcactgtcttagatgtttgtgtgtgtgtgtcctttctgtcatccccttttattttaaatccatttcagtaaatcagtttcaggtagatttctgattgcagtcttgctttaaagtcctggagctcatttagtctaagcttctggaatagcttgtgtaaccatttcctttggttaggcaattccaataagtatgtcagggccaagctttccaagattcgcccccccccccttttttttttttcctgaaaggccatacccagcatcagtcttgcacctcctcttaggggtaattagttatcagactgtgtgctggatactgtgagggatccagagagatgaatcatatgcagatcctaccctcaaggagcttgtatagcaggaggggaaataagacatacacattgatgtgtatgtcatacaaggtatcaaatacaatgattgtacaaggtaatgtggtgaggacagaaagagaggtgcagatcgggcctccttaatgctcccaagggagggaccagttccagaaagcagtagagaatacttcgtggagagatagtaattgagttgagtgcctgtagtcccagctacttgggaggctgtggtaggaggattgcttgagcccaggaggtagaggctgcagtgagccaagatcacaccattgcactccagcctgggcaacagagcgaaaccctggctttgagaaaaaaaaaatagagagaaagagtagtttaacatggaatgaagaggatcctggaatgagtctcttttttcttgtattttttattattataatttttttgaggcagggtctccctctgttgcccaggctggagtgcagtggtgtgatcatagctcactgtagcctcaaactcctgggcccaggagatccttctgcctcagcctcctgagtagctaagacttacacgtgtgtgccacaatgcctatttaaaaattttttttttattcttctttttgagatggagtctcgctctgtcgcccaggctgttgtgcagtggcattatcttgactcactgcaacctccgcttcccaggttccagtgaaactgttgcctcagcctcccaagtagctgggattataagcatgtgccaccatgctcggctaatgtattttgtgtttttagtagaaacagggttttgctatattagccaggctggtcttgaactcctgacctcaagtgatcctccacctcagcctcccaaagtgttgggattacaggtgtgagccacagcccctggccttaaaaaatcctttttttagagacagagtctcactgtgttgccaaggctggtctcaaactactggcctgaagtgattctcctgtctcagcctccggagttgttgggattacagacataagccacaacacccagcctcctcttacttttaaatacattctttcccttattatcctagaagatgaacccagaatattttccatgggcttgtagatgttgtaaatggactacttctgtagcaaaatcaatttatttgcaattaatgcattaaaataagaggtgattaactacggttgctttatttatttatttatttatttatttatttatttattttgagatggagtcttgctctgtcacccaggctggagtgcagtggcatgacctcggctcactgcaacctccacctcctgggtttgcagcctccacctccttggttcccgagtagctgggactacaggcatgtgccaccacagccagctaatttttgcatttttagtagagatgaggtttcaccatgttggccaggctggtctcgaactcctgacctcaggtgatccacccgccttggcctcccaaagtgctgggattacagacgtgaaccaccgtgcccggcctgctttatatatataatattaattgttgggtgtttttaaagctccatgcaaagaatggatctgctttaggaaaagccttttgaataaaagtactcactttttccaggaatttacattaacaatttatgttcttctaagagacattactaataatatctgcaaagatgttagaaaacatgcttcaaacctttttctcttttttcctggtgagaagaacttgtgtccttcaaaagaagattacctttgtctttcgaagtcaggaatttataaaaagagtttgctggatggaaaaatcataaaggccataactctaaaacctaatgtaaagaagaacagttagagctgtccaaagatgggaaagaatgtcttaccagtaagccagtttcccagaactggagtgggggggccctcaaatgtaagctggttgaacacttaaggtagaatcacccggggttgggcagaggttgaagaaaagctgcgagcgtcttatgaaggggtgggcctgagtgtctccttatgtctttttttttttttttcagtcctgaacttctatgatgcagtaaaatgtaaaggatattattgacttgtatttttcgctttacctatttgggatttcctaatgtagatgggcttctcaattttaaaacttaacctttaatacattttcagttccaaaaaaatttgataacttctgttttgtacctaacttccactactacagtatgtggctctgagccagccaaagattcatgatctgttgactacacagatgtttgcgggctgatcatgcctgcacatctgtagttgggacagttcaaaatttaaaagcagactgcacagatggttctagacgtgctttttgaattgtgtacctttgtaatgttttggggggatatcagaggacagccagaatttgttaccagacttttaaatcgtacaggtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaaggttagattcttttaaagctttttgataattattattatttccagaaagatatttttgtttgccccatttaaaaaaggttaaattgagtcactgtcttcattttcatgagtaccttgtagaaaactattaataatgataaataactaaacttctctagattaccttaatttttttgttgttgttctcagtacatctaagagagtagcatataggccatgtgtatgtggtgataaatgaaaatgcaggggtcttacttggttatttaggacttaagattttatctagtcattttcaactgtgattgaacacttccctttaactcccttcagaaactccaagatcatattgtatcccaggtactagaatttctgttcagctgtttataggcctccaccacaagaaattggctccaaacctattcccattacatcatcacccactaatgtcattacaccagaatgaaatctgctttgaggcttgtattgttgttttccttccatttctttcccctcatcatttcctttagaaggaaaagggaaggaaaaaaaaagaaaaaaatcagagacctgtaaacatttaagagtgaattggacatccccacaggctaaacctagagttgtcagctttcattccattctgctgtgatagagtgttctgcccagtatgtatccacatggagcctggaaagtaacaagtctggtcatgtgacaactggctttggtgctttgctttcagcccctcagaattagttcctaatggctcacatagctccctgccagcatcccgtcactggcacgttaaaccttttcaaataattcctcagaatagagattcttaggagagcactaaatttctccattctttgtgtttaattaaactgttcttgcattttaatatttgccagataagcgcttaagacattacaatacaggttgagtatccttaatctgaaaatctgaaatccgaaactttttgagccctgacatgacgctcaaaggaaatgctcattttcgattttggattttcagatttgggatgctcaaccagtaagtataatgcaaacttattccaaaaaaaaaaaaaaaaaaaaaaaaggctgggcgcggtggctcacgcctgtaatcccagcactttgggaggacgaggcaggtggatcatctgaggtcaggagtttgaggcagcctggccaacatggcgaaaccccatctttactaaaaatataaaaaattagctaggcgtggtggcagatgcctgtaatcccagctactcaggaggctgaggcaggagaatcacatgaacctgggaggcagaggttgcagtgagctgaaattgcaccactgcactccagtctgggcaacaagagcgaaactctgtctcaaaaaaaaaaaaaaaaaaaaaagtcaaaatcccagacatttctggtccccaggcatttcagaatttcagataagggatactcaacctgtgttatctacagttatagctgacatgaggatccttattcatcttccctcctttgtcacaaagcagttgactaaattgcaggttctagccctctttctctatcctaattttaattctactttttttttttttgcgatggagtcttgctctgttgcccaggctggagtgcaatggcgtgatcttggctcactgcaacctctgcctcctgggttcaagcgattctcctgcctcagcctcctgagtaactgggattacaagcgtctgccgccacgcccggctaatttttgtatttttagtagagatggggtttcaccatgttgcccaggctggtctcgaacttttgacctcaggtgatccacctgcctcggcttcccagagtgtttggattacaggcatgagccaccgcacctggcctctccttcgtttttttaactgtctttaaggcttccagttgccagtgtgctgtgttaggcttgtgtttaataacatggttaaggttaggaaagaactgggcgaactggcaagtagtttcatttcaggggcttcatgttacctacacagttaatggcctcatgtcctttgagacagatttgtctgagattagaaggaataatcatcatcaggagccccagagaaacaggatcacagtgtctaaaacaaaagaagaaacttagcgtgctctctctctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcactgttttagccaggatggtctcgatctcctgaccttgtgatccgcccgcctcggcctcccaaagtgctgggattacaggcgtgagccaccgcgcccggccctctctctttttttaagagacagacgcttgctatgttgcccaggctgtcttgaactcttgggcccaagtgatcctcctggctcaccttcctgagtagctggaaccacaggcatgcacctttgtgcccagcttggcttttatcttttaagactgggtttacatttctgtacagtactaatcactggggacttttaatataagaatttgctgaaggctgtggcatggaggatgagaagccacagagaacttgaaaaagctttggaaagaatggcattgaaaattatgggctagactagggcaacaaagtactttcctcaccccacacccatataagaagttaaaagtccttgattaacattaggatttcagcttacatttctagcaacttttgatattctagttggaggtcttcagtagtctctatggtataagctagatagaaggaaaaactttcctaccaatgtttttaagatgtaagtctgtgttaaaatctttttagcgtaattatataccttatcaaactgaaagattgaatagattcataaaaacatccacaaatatacaaatgcctaatctggacagaaagtctgactttattgtttctaatgtgtcttatgtatgtgtttattttcagttgtcgagatgtccacagaaggaggatttggtggtactagcagcagtgatgcccagcaaagcctacagtcgttctggcctcgggtcatggaagaaatccggaatttaacagtggtgaggaagaatgagaaacttttattagaaacttttaaagagtataaagagctctgggaaattaaccaaaactcagactaaagcatttttaatttcaagcacatttacagaggcatggttcacccctgacctgtgggtaggaaaatgaaaacataatttgccttccgtgaggtaactgcaagagtcttttatatctcagtgttcttccataggcgtgtggtgtgcagtggatactttgacttggaggtagtttaatgtgaggcatatcctttaggacttacagaaaaacagagatctcatcttccttcagtagctgtagctcaattttttaggcctgatttagtggccctacgacatttctagaacttggtaaaaactattgggcaatttattcaacaacaaatctattgtgagtcaggaactctttctaggtgttaaaaagatatactttgatcgcagtttctcaacagctgcattattgacattttgggccagataattctttgttgtgaggggccgtcttatgcataacagcatgtttagcagcacccctagcctctactcactagatgccagtagcacccctccccgagttgtgacaaccagaaaatgtctccagacattggcaaatgtccccatgggcaaaaatcatcccttgttgagaactactgactcagaataattaaatataacctcggcctgtgaggagcttacaatctagtaattacaaccagaataatttagtcagtaggtatttactaagtacttactgaatcaggcacagtgatgagtcctgaagcagtaaaagtcaaggagcacagaggacatagtgcttgattctttctggttgagtttaagtaaagggaacatttttgttgagtcttaaaatatgagtaagcattcaccagatgtgaaggatgggagggcaaagacaagggcatgcataaaggcatggaggcccagagaggaccttgtagttaggggaacatcaagacattcagagtgcctggaggttactgtgtgtttagtggaggttgagggaaggagtaagtatgtggtatgagagtggtagtggaaggtgagacaggttagagttggaatattttcataatacagttgtcatgtccttaatgaagaatgttcattaaggtgtcattttagcacatactaaaggagctccccatgttggctgtgtcattcctgccctggaaatactagcatcctggcagagcagacactggattccttcctgatgtagaattaatgttgcaattgcttaaggttagtgacctttaacttctgacgttacaatgtcagtttattcattcactcaacaaatacttattatgtaccaactaaggctatgctagatactgtggatacagtaatgaaccagacagacaggatcattgcgctcatggaacatatattctgatgagacaggctaataaacaagtaattaatgaaatgaaataacttattatgataaatgcccactgacttcagggataaaaagtaattcatgttttggatatacctctgggtcatgtttgtttatatgaagagttttcagcagttgaacttggcttagcctttctcagactggcctgggttcagagtggatttccactgaaaagtcattgttcctcttctgcagtctaaggtagtagttatctaaactgtctcagatatgaaagagaagggaggaataaatgaaatgataaagtcaaaaggatggggtgttttgttcatattttagggggttaatctcatgattaagcttatcagcttttggtgctggggtcagcttggtgtaaaatgaatgctgtcctggggtgtggtgggactaggccaatcgagcaagtctgtgccgcagcttgagccgagaggcataaatccaggatcaggcaagtggccagataaactctggaggtttaagctcagcacttaacttttctgttttgttggactttgatttttttttttttttagttgtagtaaaaaaacacataaaatttcgccccttatccatttttaaatgtacagttcagaagtgttaagtataatcacattgttatggaacttaccttgagaattttttcatattgcagtactgaaactgtgcactcaataaacagccaccattctgctttctatgaatttgactatttttgatacctcatagaagtgggatcatatcgtacagtcccctacttacaatgattcaacttaatgttttttttccactttacagtggttagaaaacgatgtgcattcagtagcagttgtactttgagtacccattcaaccattctgtttttcgctttcaatctagtattcaataaattatgagatactcaacactttactataaaatagggtttgtgttatattattttgcccaactttaggctaatgtaagtgttctgagcacatttaaggtgggcgaggcttaactatgatgtttgataggctaggtgtagtaaatgcattttcaacttaggatcttttcaacttaacaatagctttatcaggatgtaaccccattgtaagtagaacaacatctgtatttgtctttttgtcttatcttatttcacttagcatgtctgttgaagcatgtgacaggatgtctttccttttttatcttttttcttttttttttttcctttttggagacagggtctcactctgtcatccaggctggagtgtagtggtacaattatggctcactgcagcctcgacctctcaggctcaagcgatcctcccgcctcagcctcctgagtagctgagactacaggtgcacgccaccacacccagctaatttttgtatttttctgtagaggcagggtcccaccatgttaccctggctggtctcaaacttctgggctcaagcattcctcccacatctgcctcccaaagtgctgggattataggtgtgagccaccatgcgtggcctttgttttttcttttttaaagagacagggtctcactctgttcattgctggagtgcagtggcaggattatagctcactgtagccttgaactcttgggctcaagggacccttcctactcagtcccccaagtagctaggactctagttgtgcaccaccacacctggctaattaaaaaaaaaaaatcttatgtagagatggaggtctcactatgttgcctaggctggtctcaaattcctggcctcaagcaatcctcttgccttggccctccaaagcactgggattacagacatgagccatcatgtctggcctatcctttttttttttttaaggcagaatcataccctgttgtatgtatataccacattttgtttatccgttcatctgttaatggacatttgggttggtttcacctcttggctattgtgaatagtgctgctgtgttacatgagtgtgcaaatacctcttcaagaccctgggctttgatttgtaacctacttggtttacaagtttgattgccaacaaagctgatcatgatgttgaccaaattttagtacctagacttagtctatcagaagttaaaagagaattactttgagggattcagttttggttcaagttttgtgggtgaagagaaagaaaagtaaagaggaagttgtctttaatccttcttgtattggtgactaattaaaattctcctcctatgtacttttgaaagggactcctagacctctgccatgctatgtcttttatatcaggtgcttagaacaatgtctggcatgtagtaggtgcacaataaatatttgaacaaattagactccacttcaggtttagtgcaaagcaacatcaattccatatttgagtaagaatgcaatccagtaaagtcagggtaatttttttcccttgtgtgactcttattttcccctcttctcaggagtgcaacacgtgatggcatctgcttctctgactgcgctgctgcctgtgtaacatgaccaaacattttagcatttaatctgtccctttccagaactcaacagtacttaaaaccagacttcctcagatgtgtcagagcctcttaggttgacacctcacaatatctaacagattaaaaagaaaaaaattccttatgtttaaactagccaatcataagtaaaacttacgagaatattcataaaatgtgatctcagactgggacacaatttgtttcaaaaagaagtaattgaagtttgctagatgatatatttcatgatgtgttggaaacactggcctcaagtccttttggtctgcgtcctgtaaaagcaatttatctttcattttagcttgttctcatgattcttaaaagctctgtagttgtctataaatccaggtggtgttcagctgggattgaaattagttaaaaaccatatcaagatgattgtgcaccagagtgattgtgtaaaaccctatattcccgcacagcagagctctgggaacagcaaataacagacttcttcgtgttgagttttgccccagtgggcctctttgaaaataggaaagagaaagctaactttgtctttatggaggtgagttgggggcaggtgggcaacaatgctgaatttcgaaaagaaaaatctaattctctacttactctttacatcccattcagccttcacttaactgtaattgagtgcctaggtcactttcttttaattggcagtttcatcttttcattcctcagtgcctcctgattgggtgatgacatttctaacattacaatcaaatcagataactgtttaaacaagaacttggtgatgaaggttggtggactgttacaaaacaggtcctgtgctgtgtgagccctttctgtagagcagtgcttctcaaactttattgtctgtatgaaccacgtgagggaggatcttcttaaaatattgatgctgatttagtaggttaggaacggaacctgggattctgtgtttcttttgagttcccaggtgataccattgctggtccaaggaccttactttgagtagcagggccgtaaaacagtagtccttaactctcacttggatcatagtcacaaggggagttttcaaaaaacatgatgccagtactctacccactagagcaggggtccccaacccctgggccacagaccggtatgggtccatggcctgttaggaacctaggaactgggctgcacagcaggaggtgagcagccagtaagcaagcattactgcctgagctccacctcctgtcagatcagcagtggcattagattctcaaaggaatgtgaaccctatcatgaactgcgcatgtgagggatctaggtagcacactccttatgagaatctaatgcccaccctgcccatctctggaaaaattgtcttgcacaaaactggttcctgaggttggggaccactgtcctagagttcctgattcagttggtctccaggagagagctcaggcatcttgtttttcaaaagcttttcaggtgattctaacctgcagccccaagattgagaatcattgatttcaaagggttgagaatcttgacttgccagagtgcctgactgggtaggcctggaaaaggtttctctttattatttgaaactctggatgttcttcagtgcagcccaagatctgttgacttttctttgtctccaaactctcattgagtgaattcagatttgaatttgtcttgaaatgcagcagtttcagatggaagcatttttaacgtagttctttggtagtggtcaggagcatgagaatgttctgagagataatctgctcttctgccttactgatagaactcccaaaagtaggggggagcagtgtgtgtcagctgttcttccagttgaatcagtatcaggagaaggagttaaggagttaaatgttactcacttcagttacatggtagctagtgaagtggggagcatgaatccaagtttcgtgggcctcaatctactgattgtagagggcctcccttttccaacaagcttatggtaaatccttacatgtaactagaaggctaggataggattatagaaaactgggtgattgtcaacagggatgaaccatacacacccctcaagatccacttttacacactgcttcttgagatctcaaggtttcaggaacatgaaaaaatagtttgtcacaaagaaaagctttgggaaggggattaaagcagagcttattataaatttctgcctcattttacatctctgcaaggcgggaatgatctcttgatccttgacttttgttgcttttgattaaagaagagaaattgaaggagtaatagtttactctttcaatttggggaaagaggtcttttttatcaactttgggctttagttaagtaatcatggaacgttcttgtacaaattatatttaaaaccaagccaaacaagagcacacttgcaagagagctaaatgtatgatcatcttgtgctgtatgtattagcctgggaggttttccaaaggaatgatcatccctagcattctctttggcatttctatgtagtgtcatcatcttctgtgatatgccacacaagaaggaagaccagtggttgatttctgggattaaacttttaaaaaaactctttaggatctggccccaacccagtatcctctttcctgcttttcccctctatactcaggtagtagatctaaaacttaaataggctgtgattttttgtctctctctctgtctttgttgttctgtctgaataacattctcatactttttcaacaggcaaattcccagcatcccttagacacaattcagatgtcatcccctttgtggaacatttcccaatccctcactctccctccagccccacattgctagctgtccctagcaatatgtccttctttgtgtccccgcaggggatccctcccctccagtattgggtaggggattataatgtttttatgtgactatctctgacaaaccacaagctcttcaaaggtaggagtagatgtgtattttttttctttcttttttaaatagtgatggggtctcactatgttgaccagactggtctcaaactcctggcctcaagcgattctcccatctcagccttccagagtgctgggattacaggcatgagccaccatgcctggcctacatgtgtattttttgcatagtagtaggtatcatacatttactattagttgagttgcttgaatcagtaaatgaaagagcaaggggaaaaacaagaatagaatgaacctgcgctactgtttccttttgttgaaattttaataaactgaacttctaagtctctgttactccagggttagttttagtagagggttcatggaaaatgttgatacctaatttggaaaaggaaaagatgaaaaattggtgtttgaagtttgtagagcagagtggtagccaagcagcttgttgggtttgcatggaaaaattagatgtcttggtgtacattttatcctaatagattctcttctttctataatcataaaataggttctgggaagactgttgatgtttttccaaaatacctttttttgacatatatttgagattttctgttggtcttgcaaaagaaagttcacttatgcttgttaattacatcaaatctgaaataatatatgctccttccataatgtgatgatgcaaattcccaggtgagcatattaggtttagtgagtcacatttcagaccacttatagaatcaatcatttgacacctagtcccagtagagattttgctgattttagctaatatctgcctttgcaccttcctcttcattgcagctctgaaactcaaaattgatttttttcctagaattgcatccatcattgggcatgtgtttaaataccagtagtttcaaaataaaacaaaaaagggcttaagtctcaaattattgagtagtgctgatcaaaaaagccctttcctaaactatatccacagtgaagttatatggtcctcccccactccaggcttgttaagaaaaaataacacagctgttcctaaaaggcagctgacaaattcaccctcatcctttttctatactcctctacccccacttgaaacaaattttggagacaaggccattgctactgtgatgagaaaggagctctcctccccagtttctgttgtcaggttagtgcaaatgtcagaaatggccactatcagttgtaaagaactgtggatcactgtggtcaagtgccccggcgttgctgttagtttggtcactgaatggaagaaagaactggcagtttagaggaatacccctgagacagaaatctcattttaatctgcatattgcagactggtaaacttacttggaaaaaaaaagaaggcgctcataatgtccctctatgttgtgctgacgaaaaaaaaaaaaaaacagatattgcttggggctgtgtttcatgagagcactgttagaggccatcctaagctttttctaaagcccattaattctttgaagacctgcatatgttaagtaaagaagaattttgctctggagcttgtattttcttcatttcatctgtaccttctctcccgacatacgcttcctgaagagagggaccaagccagagtgtttcctactgcctgtcatgctttgccacactgttgattgtccccaccatttatgcatctcttgttgttcatttcagaaagacttccgagtgcaggaactcccactggctcgtattaagaagattatgaaactggatgaagatgtgaaggtgaattcacattcatttttattatttcttattgaagctaagtgatgggtaggttattgctcatttctctagagctcaaagtttaattaaacaagaacacacaaaaattactgtctgttgctttgttatttggttcctgtgcaaaattgttaagtgagccaaaattgagcagttttggttactatatggatcatcctgaaaattttttagatgttgaaaaaatagttgatgttgggttttttttttttttttgagagttttactctgttatccaggccgcagtgcagtggtgcgagcttagctcactgcaacctctgcctcccaggttcaggcaattcccatgcctcagactcccgagtagctaggattacaggcgcccgccaccacacctagctaatttttgtattttttgtagagacagggtttcaccatgttggccaggctggtcttgaactcccgacctcaggtgatatgcctgcctctgcctcccaaagtgctgggattacaggtgtgagccaccgcatctggccttttctttctttttgagacagggtctcactctgtcacccaggctggagggcaatggcataatcacggctcactgtagccttcacctcccaggcttaagtgatcttcccacctcagcctcccaagtagctgggactacaggcacgtgccatcatgtctggcttaatttttaatgtttttttggagtgggggacaggatctcaccatgttgtccaggctagtcacgaactcctgggctcaagcagtcctccagcctcagcctcccaaagtgctaggattaggcatgagccaccatgcccagctggtatctcacagttctgttcacagtgtagtatatacatgtatcatcaaatcaacaggacagtgccatcatcttagcgtcttacatagtttgttgatctgaactcttaagaaatttttgataatgatattctacctgttctaaccttttgatctatgagtttcttttacatgaataatacttgtgagagggtttgcgtgggcttggccatttctgtattcctaggagtccatctccattacagatctcagagaaagaggaactctgtctctttaccactcaaaattaatagtcttttgtattttcacagaaagctaacaattgatagtaattttcccttttattagctcctttcttcctcacagtagccctgtgagatttgatataataagaattatcagttccattttacagacaatggaaatagacacaaagaggttaagtgactcacccagagtgataggaccaagatcccatttcccatctgctgcttctttaactccagagctctttctgtggctgtatcctgcacagactacctcaccaaaggtttagaaccttgtttgaccaagagcttcaactttgaaatcagacacatcaagaaagtttatatggcttgagcatttcctatatgccaagccctgggctgggtacatatattatctcatttgattgccacaataaaactgaaaggttatcctctttttcagtacatgaaaaagcccaaaaggatgggaagcctgcaattttatccaaatccattggctttcaagctcattctccttcctcatattgtttctccttggattagaacctaaaccctgccacttactggctctatggctgtgggcaagtcacttcatctctcttgacccctagtttctttgaaaggctattataagagtaagaaaacaccttgcacaaggtttggcgcatggtatgtgctagataagtattctttctccctgttacctgctttgttcccactcatggatttattttaccttggaatctcttgagtataccacctcattttttgacccttgccccatagtcccatgccaggcaatgaggcaagagacagactggtttgcatgacttgctggtgattgacagggagggcctgtgtctgttacagatgatcagtgcagaagcgcctgtactctttgccaaggcagcccagatttttatcacagagttgactcttcgagcctggattcacacagaagataacaagcgccggactctacaggtattattgcagacttagattaggaaaactggggtaagcagcagcctttgcctgttttcctgcgtggtgttggagaaagattgttctcctttaggaccaaagattgttctcctttaggaccaaagattgttctcctttaggcctctatcaagctgacgtgtcattggcatcaccactgttgggaggcagacataccttctagccatggtgattgtgtttctccaccaaaaatcttaatcaattctctcctggttttcacagcttagtgactgaactcttttcccttggtgagccctcactataaacagaggctcaagtgataagagtatttacctgtttccaaacgtaatcaacttctggttgggagccttgagagattccaggaagtatcatcagtctcactagcttcattaggctttttgttccttgtcagccttcctgggagtccttttctttttcttcttcttttttttttaattttaatttttaacctagcgaattcacattcatactgtatgcagagcccttggtcattgactctagaaaccctcaccctatagccaagccctggctcttagaggaaagatttcccagatacaagaagaagagtgtaacaagtataaaacagtggtggcagtattttaacaatgaagccaagaaagtaaattattttctcttcttgtttccctttacctacaaagtagaaaatgcatgtgtttattcatttattctaaaaatacttactgaacacccacaatgtgccgggcacttttctaggctctggggattaacgatacacacaacagacaaaaatccttatctgtgggaagcctgcattctagtacagcttgtcaatgcgtcataaagttaggatttgtgtacattactatatgaaagttttaaagcaaaaaaagcaaaaaatactgagctccaataaatgatatgcatgttgaagtcacaaaatttatgttgccttgaagttagtctgtggatccagagagatccagttaaagctcccttcaagatcaattcagattagaaaataaaataggcaaaacacttggacagaccttcagaaaaaaagataaacaaatgcccaataaacccatgagaagatatgcaacatcattagtcatcagggaaataaaaaactgcagtgagatactgttttacacccactagaatacctaaaataaaaaagactgacaataccacagttggtgaggaagtggagtgtctgaaactcatatattgctggtcagaatctaaagtggtcagtcagtttgaaaaaatattagacattttctgataaacatatccccctactctgtaacccagccatttcattcctaggtttgtacccaaaagaactgtagccattcttatataaaaatgctcttaacaaccttgtttatactacctcaaaactggaaacaactcaagtgtccatcaatataggaatatataaacaaattctgaggtattgatgaaatggattcctcctcagcaataaaaagaaacaaaccattgctccatacaacatggataaatctcaaagatactatgttaacaaaaggaaccagagggaaaaaattacatagtgcatgatacaatgcattattaccacctatagtgatagaaatcagagttgtggttgcccagatttaggggagtgtggggaaggatattgactggaaagggctagaaggaactttctatattccttttttattttttgagatagggtctcactctgtggcctaggctggagtgcagtggcgcaatcacagctcattgcagcctcgacctcctgggctcaagtgatcctcccacctcagcctcccaagtagctgagactacaggtgcatgccaccatatctggcttaaaatttttgttgttgttgttgtagagatgaggccttactatgttgcccagagctggtcttgaaactcctggctcaagcgatcctcctgcctcagggaatttaaaaagcaaataaaaattttaggaagaccaacttaagtatatctatgtttccaaaatactctagaatattttattatatgctggagatgtttattatttttctttttccccttttattccatcaataaatgagccatttagatagattgagtagatgacatcaaaaaatgtgacactatattgtagtcatcttaaatgagttctggcaatcttaagatgggccctgcttcagttgggagggtttatcgtcaagctcgtggttggcaagaagggcggactagagttttgcatttcagaggcttggggccatcacagatacaagggaaagaaaaaaaaaatttccatcctctcctgttttgtccgatgagtcaccttttaaggtgtggtatatagagtttgctaaggatttctgttagtgtgttaacattttccccagcattttattatgaaaaatttcaaacataagcaaagtttacagtgaatacctgtatacttacaacctagattctaccataaacattttactatgcttattttattctcatatctgtttatccctctatccatccttcaagtaatctgtttttaagtgcattgtaaagtttactttgcccaaatactttaacatgcatatcattcactagcgttcagtgttttttcatattgtttttccttttgctttaaatctttagtaaagtacacaaatcttaactatacataatatgttgggttttagtaaaaatcttttaattttattattcaaagaaaggaagtatcacacttggagagaaacccccattagagcaggtcttggtttcagtatcattagccttctgactcctgtgttctcttacctctcttgctgctgttcatagcacaaactatgaatatcagaattctcacaagctatgttttttatttgggaattcagaactgcaatgataaacccatggtttaagtattgcaatttagaattcccaaataaaaatcatagcttgtgagaacttagtgtatatagatccagtgacttgaaaatgttgcaaaaagttattgaattaggattttacctaattcaatacttgtgaaccaaagggaaaatattatttagggccttaaaaagattataaacctaactttgctaacccacagaatgaccagaaacctgctaattgagattactaggtttgtaatttgaaaatcgcggggagaggatcaagcaggagtagcagtggttggaggctcagataccccattttacagtgtgagttacatgtatctctttcttttttgttgatggttgcccaccaggtctgatcatttaaagtatatgagtttggctgtgcttatttcagctgtagacttgcccgtaggtgtttagtttggcttaaaagtcgtcttaccttacttggagggtataaagccaagtgaactagtttctccccaggctaatttttcacaccgctcttctttgttacagagaaatgatatcgccatggcaattacaaaatttgatcagtttgattttctcatcgatattgttccaagagatgaactgaaacctccaaagcgtcaggtgagctgtgaagggattgcagttgctgctgactgaagagcgctttgtatactggtgtcagatacgctccttctctctcagcacaagtcatttgctattccttttgcttctcgtttctagaccagattcattcttaacatctccttctgttactcatttctggatacttttaactcagtgcctccgaagtggtatttcagtgaaaatagacaaaatgaaaatgaaagactttagttacaaatggtaaagttaagctcatttcaagttatcttaggaagtctatcagagctcttcatctgggataggagaatattcccagaaagttatagattttagatttttaagaaacagcttctctatgtgcacagtggcatttggagtgaatggactatgttttctcttcctctatattgtggttcattatatctttatatagtaccctgactgcacactagaatcacctgttggggttttaaaaatatcagcgcccaggctctaacccacatcagctgaatcagaatctcatgatggagcccaggcatcagtaccttttaaaactccctggatgcttttaatgtgcagtcagatttgagaaccaccacttgagctgttttgcaagcaatcacaagaaagaatatgaacgtctgccttcccgtctcttctgcctgcccctctccaaaggtcacactagttgttttttcagcaccttgggtgcatatagctcttaattgtgattgtaatagacctctgtcctttagagctcattgttttaagcatgcagattgcatgattcactaggtgccacttgggaaattgtggcagaatctcacaggagcaaagctgtgccttgttctgcttgctttgttatataaaactttatttttaatgaattatttcatagtatattatccttagaagcagtcattcagtgacagccattctccccatcccagcctgtattaataaccagtcagagaaagtctaggagaagtgggcatcctaatgaacatttgtaattctgaccctgcatgagggcctttggattagcaagccctctgtcacctccttactagagtagggtgtgcctcactgcgtctccgttctttctgggcagtctttgctactgtaaacatccttgactggaagctgtaaggtgttcagaggagctttcagtcggatgtttacagcggcaggctgccacggtcgtccccagctacgcaccggctttgaaacattgcaggtttgtgcccacaggctcaattcctcctcttgggggtccttccctcctctctcagaagtcacaacaagaactcaggccatttatcttccttcagaacaaagagtatcatacacctgctttccttgttgaaattgttttctccttttgtctatcagaagccccctttaaaacaagattgtgagctctgtgatgaaatcaggccttgctcactctcattgtgctaactccttgttttctgtgggctgcctgctgaatacactggctggagagaagggtcacatcctgtcagttcctccaaattcctcagtgcttctgggtctctcggggtgtcatacagctccttattccatcttagccagactcaaaatgctatgatccatctgattttaaagtgtgtctagctgaaacagcttcttgttgcttggatttagttctttgtaggtgttcgaggcattgattggcatcgtattcgggacagctgctgcctggcctttgaaaggttgagattgctgaaagctggcctgaaattctaagatagcatttttaatcctctgtagacatgaagttttcccaggcttcaaattggctggcacctcctaaagtcctttaaaacgcctactctccaaaacccaccctttctgaaggaggcagcagttcactcttgctactaaagcgaatgtacttttttccagtcagggctggttgcacaacactgtagagatggccctaggatgtgatgctgctcttctctggcactgttcgtcagtctcagcttctggaaagattccaagagcaagccctgtagttggggaggccactgctaaagttgagcaagtgccccattctggattgatccagtcattaaagcattgttctgccacttggggcaacctcccactgctgggaaaaggaactagtcagaaatactgaattgtgagtccaaggccctgacttctcaaagatacttgagagtttcgcttgttcttcagagaagcaagtaaagattatttgaaggtaggaggtagttgaggcctgacttctgccccactaaagctattgagttgaaagttcctgcccattgaaatgtcattatcttttcacccatttctttaaaccaagcataatcatttccttgctggcttgacctccattggcagaatgagtcttcataatgcagaagagccttagatatgccttcttccattccagtgatttgagaacagttgtgccttgtcctaacaacacaaacctaggtgcctccacttgattctcagtgtcctagatactgtctagttcataaacagtttaagaggatgtagtaagcagcataggaggagctcttgtcctgctctcacagcttttggcaagagatattttgggttctggaaggggtttttaaagggtttgctttttgtctgacaaaaagatcatattcaatactagatcagctgtagttggggataactggagactaaacaatcacaggtcacggctagaaaatgcaggtgtctccctgctgcctagcttcctacacagctggttctgaggctctcattcctgtataccctctcattacccaagagcttttccaagttaggtctggatttcagtgatttgtgctttttgtaaaataataagggagatctcagtggaacacaagtaccttgaacctacttcaatagctttgcaaagagcagttggcttctgtttcttggctgcaaaaggtatcagtattttagctttgccacagccaatacctagtttccaggctgacatttatttataatgatgataagttggggttgaaattgttgtggaaattgagacctagatgaaaataaaagggaatctccttttccttctgccttagcataatcatattgagggttaaaactatttgtgtctgaagcacagactatatcaacctaaaaagtcagttcatatattaacttagaaacccagaatgttacaggtatctccctaagctgggtagatggctgtcaagtaaccatgtcatgcagagacccatgtttctcaggggtagatactggcagtcctagttttagtatcctagcccccagacatcaggcaaacaaaggatactcagctctgttccacaggggacactagctgcttcctcacactgtggccacagagtcttagaggtaccaaaagagagtttagagactacttttttctattggtaacagctgttgggtttaagagaatttgtcatatcagcaagttggattcagagaactactttcctgcctctaactgtctgcctgtctaaatccattcatcattcatcacgcacttactgagtgcctacctgggaacgcgggggatagcagagagcaagagagagctaggctttgccctcatggtgcttaacattttagtagaacagacagttaatttgacatgcaagtgcaaaaatgtatactgtgaggacagtactttggaagcacagttgagggcacctaacatagtgtggggatggggtcaataccagctttgtaaatgttactttggggagttggaggcaatccacagggtctgtgtacatctaagaagtgtcttttcctcttttctggaacgtggcaaactttgccctgaataaggacatgagtaaatttagctaatatttttactcagccagcccaagtggttctgtgtttttattgtttttgttgtcccaggcaggggcaccatgtgtcacacaggtcactccggatcagacgccgttctgtgtcagtggtcaggggctgatcaaccctggaccctgtgggctataaccatgctgtagtgtgtgtaaacatcctacactctcagctgtgagctcaaggtggctgggagagggttgtttactccttctgccatggaaaacatcagctgaagaaggaacagtctccactccgcagatcggacagaatgcgacctccctaatcagccaaggcagtaccccagcggagagctgtccatcaggccccctgggttgcgcttctgtggctaagtacaaccagaaccagatgtgacactggatagacatgccctcagtgaccacagagctttcaacaagctgtgaaaagctgggtacttgcctaccagtgctctcgatcctgaaatttcagctcaggaaaagccctgtttcccattaacctgttctgtcccccttgaagtggtggggctaaaacgagaagagtgctgcctatttgggagattgggaccaggcctgagaggcatgatgtttgggtagcatcttcccaacacttgcaattagcactgttctcagatcacaggccttgacagcatttactgacaagcactgctggtgtgtggtttttagttacggtacttatttgcccgtttgcaacttatcatgcaatgggtgattatttcgtacttcagaaattggctgtatgttttgtgaagcctataggatctgttatttttagtttgatttagcataactggtctctttgaattccactttcctttggcttcaaatgtggagagctcagcattcagcaggcaactgcacatagcctgtttgggggaagagtggaaattcactgtggcggctgctgagttggttcttttcctcttacctgcctctctttccacccaacaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccaggtctgtgagctgctgaggatgcccatccagcaagacagtgccccttaggtttttggatgggcagagcttgatgagggcagagaggcagccagatcattatagagcactggatttaaagtctggaaactggaacttttccccagattcagctactggggtgagatgttaccctaatctctctggaccctgtttttctcaaaggtcaaatgaggaaagtgtactagacagtatgttctccaggatccctattagctcagaaattttagaagggaaaaaaaaatgtctgaaatgccttatgaagagtagaggtgctaaagtgaactccatgcctgctgtctgtgtgtctgtgtgagaagtggaatttgtgcccttaaagggagagattaggtatcattgccaagttgcatactccttctccccgtcatttctctgtcccatatttgtgttaagtgaccttctctttttacgatagtaatcagaggactctttctctccccagtagtagtgttaagagcagtagcattcatgtttgttgggggtcatgtgaggctgcagagaactctgtactatgagctctgaatccaaattctctgtcaatcattatttattcatcaaacactgagcatcctctgagggtaaagttctgtgctatgtattggggatacaagcatgaataaaacagtccttattttcaaggaattcacaatttagttggggatacaaatacttaaaggttgtaccaccacgtgggaatgtgtacagggtgttaaaggaacacattaaaagaagtaccttggctcagcgcagtggctcatgcctgtaatcccaacactttgggaggccaatgtgggaggaacccaggagtttgaggttacagtgaggtaggatcatgccactgcacttcagcctgggcagcacagcaagacctcttctttaattaaaaaaaaaaaaaaaaggcaggggcatgtggtggctcatgtctgtaattccagcactttgggaggccgaggcaggaggattgcttgagcccacgtgttcaagaccagcctgggcaacatggtgagaccttgtctccaccagaacatcagaacattagccagccatggtggcatgctcttatggccccagctacttaagaggctgagttgggaggatcgcttgagccaaggaggtcaaggctacagtgagctgtgattgtgccattgcactccagccagggtgacagagcaagatcctgtctcaaaaaaaaaacaaaaaaaagtatatgtgtgtgtgtgtgtgtatgtgtgtgtgtattatatatgtgtgtatatatatgtatatgtgtgtgtatgtatgtaggggaggggatgagtagctgagaaagatgtgaacgaggtggtcagataatgtttctgaagggaataatatgagtcttggggaacagtggaaattaatcaaagaaagtgggaaagggtggtattgccagtagagggcacagcacaggcaaaggctcagaggtgagaaacagtacagggggccgtaggaaagtagtcagcgtaggggaccatctacgcaagtttggaaagatagatagtaaacacatcctggacagcctcgtatattctaataaggagctgagtttgcctagaagaaaaaaaaatggagtagaggtagattgattgattgatgtttttttaaagataagttctcacttcgtcactcaggctggagtgtagtagcacaatcatagcttactgcagcttcaaactactgggctcaagcagtccttctgcctcagcctcccgaggagctgggactcccaggcatgtgccaccacacctggataatttttaatttttttgtggagatggggtctcattatgtttcccaggctggtctcaaactcctggctttatgccatcctcccaccttggcctcccacagtggtgggatgacaggcatgagccaccatgcccagttaggaggtagatttaagtaattatgatttggccaggtgcggtggctcacacctataatcccatcactttgggaggccaaagcaggagggtcgcatgggcccgggagttggagaccagcctgggcaatatggcaagaccttgtctcaaaaacaaacacacagagaattaaaaataagtaattatggctgggcgtagtggctcacacctgtaatcccagtactttgggaggccgaggtgggcggatcacaaagccaggagttcaagaccagcctggccaatatggtgaaaccccatctctactaaaaatacaaaaattagccgggcgtggtggcgggcgcctatagtcccagctacccggggaggctgaggcaggagaatctcttgaacctgggaggcggatgttgcagtaagctgagatcgtgccactgcactccaatctgggtgacagagcgagactgtctcaaaaaaaaaaaaaggtaattatgattttaggatttattctctgctcattttacttatccatataacaaaaatgtattgagtgcttgttctatgccagacactgtgctaggcaggagggttcaaagataatggctgctcagtcactggctcaaggcctcgactgtatcatgatgcctaagggaccttctttggctaatgcttgtgcctctgcagtggtgaaaactttacctgccaaaggctttatccctttacagaatgaacttagagggagtctgccaagggcaggctctgattggctgatcatcctaagaagctcatggctgttgtgccctgacagcagggcacaccatacatgatttgacagctgccatgctaacacaagccctcattttcctgaaatgatttagaaataccttggaaatcctctcgggaaaattgggttgatacagtacagtgatgagttggcagcatgcatttctttttagtcagcgagaatttcatctgtgctcctctctgccaacccagacgtgctcagcttggagctgataaggcttgtgaggatggtgaagttggtccttcccagcatttcctggctgttgtttcaccatcctgctgcttcagggtggccttgtgctgtgtcacacctccctggacccgtagtgatggctatttcaagttgagtgcaaatatccttcgtaggacagaatacatatgtattaaagcagagttggaaagaatgcatattttggtaaaattaatcctgtgttttctgtcataaattgaaaacttatttctggaggttgggaataggctgagttgaaaattgtggtacaagaatggaagaaatgttttctgttagcctagcccactgcatgtacttttagaacactctgtcgtctttctttttggccctcctccagtttatagtaatttctccgtagtaatcccttgaatctcatctgtcgttcccagaacacatccccttcccttgtaactttggatgcatagttgtaattttcagtaacctatgcagtcagaattaagaacatcagaatagcaacatcggttgaagtttatgattcattgagagttccatagtcttcttattgaggtgattaattcaaagtgaggagagatagtgatggaattcaagtcagggattgggtgtacaggtgtagtttaaaaggctccacccacgcccacacccccgccaccccccatcactaccaccaccagatgagcccagataggctcactgctctaggtaacctgtaaaagtcacaaacagtactaaaggtttgagatttgaaagaataattgacccttttggcagcttgtgtctttaccgtctcaaaagagtacatttcataggactacaaccattgtgtgtgagagacagaatctgccaagtcatacacattgggcagaaatttcttaaatctgagattgctatttttagaaagttagagttcttgctttcttaaattctattaattaggggtagacttagttaagagtctgtgtcttaacagtgcccagtgagttagcagtgtttgctctcctttgggaagccatactgtggtccagagcagccatctggccagtgtgggcaggaattgctctgcagcttgaatggggtgagagccagcgtgcactagggcccgccttggagatgcacccctgtgctttatttttctctcagtgtcttacatgcctaagaaagagcacatgaccctgaactaaataaattcatactgaccctttccatttaatgttcccctccaaattcacctgccccagacttgactttggctatttctgaagtaaacggtcatggttgcttttgattttttctgtagtgtatgtgccttatcactaaaggggctgtgaaaagttgcagcatttggggcacagagatttatgtttgggacccatgcaaatatttgtactgtgagcctaaaaatatttttggtttttctttcgttttggagagtaacttcagcaatgctgtaaacccagaggactctgtaggttattactagtactgagatgaccttaggcattcatggagagggtttgctcccagcacattgctcgttattaacctctcggtaatcctgtgggctctgagcctgaactcacgcagcattctcataactcttcctttcagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgagtcctgccctgaggtctgtctttacaactttatagaaggaaatacttaaagatatatataccttgatatatatatgtatatctctatatataccttgatatgtatatctatagctatatatataccttgatatatatatctatagctatatatataccttgatatatatatgtatgtctctatatataccttgatatgtatatctatagctatatatataccttgatatatatatctgtagctatatatataccttgatatatatatagagatatatatcacacgcatgcataatcctttttttctttttaggagacaggtcttgctgtgtcactcagactgatgaagtgcagtggcttgatctcagctcactgcagcttccgcctcccaggttcaagcgattctcctgcctcagcctcccgagtagctgggattataggcacgtgccactatgcccggctgatttttgtatttttagtagagatggggtttcacagtgttggccaggctggtctctaactcctaacctcaggtgatccgcccgcctcggcctcccaaagtgctgggattacaggcatgagccatcacgcccagccctcagtacttatttatatatatgcgtgtgtgtgtttgttttgtttttaacctatatgcccagtgttcctgaccacaacttgcttcactgtgtttgttccctgctttcctttaatctaggttcaggttcaccacgattgggcggcttctctcgatttcccctcattctacctatgcagggaaatcattgtaaccactacccatgccaaggcccaaaggccctgtgaggcagtcctgtatttgattagcagaggataagagggaggcgtatagggaaggccataaatacacttgttgcatattcatgagtcagttcccagtggagcctgcagcaaagtgtatttttggctttcatataacttatctattcctttactgtggactgctgcttcctgtgtgccttgagggatttcatttcttagatttgttggcttttttatttgtactccttttgtaaaatgtgtccttgtcttaacacttgcagtctttacattggtcattttgaccccccaaaactggaaagtgagtgaaacagagcagtccttctattccctgccctttgccatttttgtcataaatgaaacgtaggcaggtatagaaactcacgtagacttggttaaccacttcctctgtgaaaataactctaaaagtatcctgagatcagtttaggaattgttcttcatctgaagttaacatagtaataggccaagagaaagcttaggaaagtggagtgtgtatgtctctttctctacctctctcacgtgtgcttacgatacccaggattgcagatgactgagctctgccttgcttcattgtttcagtcctcaaccccaagatttctgttgaatggttctcatttttgcaagcgaaggcaccaccacaggttcatttaagacagagaagagttccaccttgcagatactttaactctctggggcacagagctttagcccagaagatttgttgcagaattcactacttcatcttcactggctcaggcaccttctgtaggagtcttcatttccagactctttaggcagctcattggaatgttcctaatagtgatgagcttcaggaaggaaactttatttccctttcaaaaacccagagcttattttctctgtaattaatgtaaaaaagctatgagggtccccagacctgtcctgctgtagaggaatgagggacggatcatcaccaaatgtcttaacctaggccaaaaaggaaagcttcttgctttgttgaagagctgcttggaaccatttggctcacagcttttcagtcacatttgggtttctgcaaagagctcttcccagctagaaaattttaacatccctgtagctgtcagtataccttctcccactcctgggacaaggctttagtttttcatcttgtgatccctggctggagttctggggactcctggaactagccaccatcagtctctgtagatgaggttttccaaacttctgcccagctgccttcctccccacaagcaacttaacattgttgccaggaagctgcattataggatttaggtggggaattcaggcttggcaccacagcctcccagcagcttctcttggcatattctcaggaaagaaatgactgcaggtcctaatactcttgccctgtctcctttgaaccagatttttaatgggtttagattgggtgtccctccatcttgcctcaagtgggcaattctggaatggtctaccgtgaacttgagaggtcgttttttctcggtagttcaaattctgtgaggctggaagtctcagagaagcattttgattgaacactgcgtgcaggaatgcagcttcatcccattagcattttcctcatggaagagtcctgcagtgaagttagctcttgaaggccagagggaaatttgctccagagcagaggcaatacttgcctgttagccacaagaagcttccccttgcaacaaaggcaggctgggcagccagggcaggtggtttctggaccccgcagatagagacctagtctatccatgctcccagaacccctttcatttcctctaaattgagggtgtgaatgtctgcagtcctcctctgctgaccatcatctttgctgagctacagttctctgatgtggtaaccgccttggtcctcttttcatccccagctcaaaacactaatactttcatggtacactggagcattaagagcctgagttaaggcttttagcacacaattaaatgcagcatgtggtattattgtattatctgagatttaatcgtaagcatgagagactctaagggcgctttcgtagctttggtttcccatgatggggttttctatgaaaggtttattgattctgcttccccttgggaggtgtttggccagaagctagtgctgaacaccaaagatcctaaaagccccacagacccccatccagcctggctcttggggacagagatggttaagcagtccagcttttgcctccaaaatgtgcagcatggggcagggcagtgtgagggctatgatgcggaatgatggctgtttgctttgggatcctggcagatgctggatctctttacagatgggagcgaaagaggcccacacttaatgtacaggcattctgatgatgtcagtcagataaattcctaagataagctgtgatcatgtagctaagagctggcaaataatgagcatgcagccatgctgttctcacctttgtgacaggatcttctgggagttttttctgaagtccattcagggaatatattctcttctgtgctgtgtgacttgtgggatgtggatgttctgattttgcttgttttgacctctgtttaaaagggacttttttcagggcaggcttctttggagggcttgaggggtagggggcaatcaacatctctggtcatggaaagtttgcctgtttgagattatactcaatgtcttatggtctctttgtctctgcccctgccctaggtgcagctgaatgccggccagctgcagtatatccgcttagcccagcctgtatcaggcactcaagttgtgcagggacagatccagacacttgccaccaatgctcaacaggtatgtgccccagagacacaaggcctgtgttggagaccaggagcagatggcttctgacaggaaaggagcgctcagcacacagctgtcttgccacctcatccttcaaccagaagcaccacccccacaccctccatatccttctgcacccaagaggcatgggtggtaattggaacattagattcaaagtgttttctcttaccatcttgttctcaaggggcaaagaaatgcaagtcaggggaagcctcgaaggtgcctgaaagaaaccttacaggtgtgcacacccatcagacctgggaaatgttcgacagatcgcctgatcgtcaggctgtttccatctttaaacccaagtggctgttgtgttctggcacctcctgtgctctttggaaagcttacttagattttacccctacctcctcttgcatccctaaccagaaaaattgcccttctcctctcctctcgtgccctacaatattgatggctatgagtcacagatggtgagggggctgcctccctgggcttgggggtgttgagggacatgggtattacttgcagaagatggggggtgctggtcaaggggaggcattgttaatggattcttttgcctcagacccaaaaaaagcagcgatcgtttaagagctggacccgtctggcccagttgcatttctggtgatgtatctattgacagtggtgacagagctgagtttgtagagcaggtctccaaagatctcatttgggaaaatacgaggaatgagccaaaagcaaggcttctgagttccatatagtctctgggatcattaagggctgtttctgtgcccactccccggcttacctaaggacgcggcttttccgtagctgatactgactcacacccttcccccagcccctctttttaacctcataagattcttccctgggatccaaaaaacataacggcatgggagtgggaggaaatgagaaggaagcttcttggttcctcagaagtcagtttggggctgggcacagtgggtcacgcctgtaatcccagcactttgggagggaggctgaggcaggtgatcacatgaggtcgggagtttgagaccagcctggccaacatggcaaaaccgtttccactaaaaatacaaaattagctgggcgtggtggtgcatgcctgtcatcccagctacttgggaggctgagacacaagaatcacttgaacccaggaggtggaggttgcagtgagctgagattgtgccactgcactccagcctgggcgacagagtgagactctgtctcaaaaaataaaaattaaaaaaagtccgttttgggaacagaactaaagccaaaaaatgggagaggctggggagaagcaagaaagtggtagctgaaggcaatgaaaatctttgtaacaacaggttgtaattatgacaacctaatacttagtaggtgctcagtaaatgtttgttgaatgaagctgaatgaataatatgtaaataaaatgtaaaggtaaatgaaatctcagctaatatgaatggcaatcctgctggccacagagcagttaaccttcttatctatgtggaatattttccatttgtctcaggctcacttgtttattctgcaacatttctggaatactaactttgtatgggctcctgccctcaggcatcttataggctgttggaaggaaaaggaccaaaataaggaacaatagtaaaaaatagtcatgaagcctgtcatacctgttccctttcttgttcctcatagcctcatgggtaggcctgcaggggttgtttttggccatggtgaggacatttgagaggacagtccttgtcttgcaggctggctgtgatgattccaggaaatggtacacagaggacactgctggccaaatgttccataggaacacatgtgcatgcacaccgcagtcttctttctagtttaccgagctgctcccagcagttgtcattatatatgcagttctacatgtcagtacatttatctaaaatccattcacagtccacacataagattttaagtacttgtgataaatgttgtctttgttccactcccggtccctccccttttctcctcccctcctttggcccagagggctgcacagtgcctctctcggaaaaagtacttcataggtttgccatgaggactgctgggaccaaggccacttgctcgccagggtgtttcatattccagtcagatgatctgggtgatacgggtttggtttggagcccaccttccaagaatgaaagaggccacttaccactttgtctgacactttgcagtccgccttcactggctgaaagactgactcttaggacttctaccccaaaccatagcacctagggtccatgtgttctgtttgagcctcagagtttgagatgagtgggtggttgagggagtaggcattcattagagagatgggtgtgggaactatctattatgtgctccaggattctcgatgtcactttgtgctgccaactcttgacgtagccatcagtgctagattaggaggggtgcttgcttgcttactacccattgagcacctgctgggcactttatatgcattgtctcatttgatctttatgaccctcttttgggtggtgggctggtggatcagaccctgcagctgacataccaactctaccatcttgattcttacagattacacagacagaggtccagcaaggacagcagcagttcagccagttcacagatggacaggtagggtacccaacctgggctgggcagagggtgaggatttgcggggcagggtagcaggtagtatctgggtttggatggttagggcaactgtcctgtcctctactaacagtgagtggacagaaattgttaaaacaagtacggtatttaaatcagggcacctatcctttagttttatagacttagtgggaactaaaataatcttagacatgtagcccaaattgccattttacagatgagtaaactgaaccctggagatgggaagtgccttgtccatgctcccctagatgttcattgcagagccaggactagagagcaggtttcctgtttccctctctagaactgtatttttttcccctctaagccatgatgctgttttaatagcatggactgttgagacgcagagaacacgtgacctcttgagctctctgggtgcctgaaattcagtcattttcagtccatgcgaggagagaatcttcccttttccctctgctttcccctcacagtacagtcccagagaccactgaggacatgataggatgacatgcccaaacttgtgccctctgctgctcaaaagggagaagagctggcatcaggacccacctctggcttctgccagcaccacatgctaggcttacatgccagggctcccatgagggcttggcttttggcttctttggggagcgcctgggaaaccaagtagtcaattagccctgaccttcctaagtggctgtgtgagtatcttctccacccctggagcgtcttggctatagttaagtgtttaataccaggccacctccttagcagggtccatggagaaaattcaaattcagtttagtttcaacctgagccagatattctgagaaaagaaggagaggagggggtaatcctactgcccctgccagtgtagattaccaagagttggggaaatgctgacttccaagctgctggtacagtggttcgaattgcttgtgtttgccacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 37502 - DNA, 11677 bp, Homo sapiens; identical to SEQ ID NO: 36506

SEQ ID NO: 37503 - DNA, 36086 bp, Homo sapiens; identical to SEQ ID NO: 35911

SEQ ID NO: 37504 - DNA, 2024 bp, Homo sapiens
agcggtcgggtccgggcgcccgcgcagaatcagctgtctgagctgcccaggcggcgggggagcagcgagcgggcttcagcgagccgcaggaggcacaggcctgtcctgggtccccgcaggtcagtgtgaaggcgtgcgctgccggcggaccctgggacaggggtggagggggctggcagtaggattggggagggggcggagaagggatccggtagattggggaggagggggatgcggagtcgcgggggcgggggcagtggagggagaacccccgaagcaagcctggctcgccttctcgacgcccccttgcactgagtcctccatccattttagtgctggaaatggggggtgggggtagcgaccccgcagtgcgacagtgaaacgtagacatattctggaaataaccccttctcacaatctacacccatggaaacacttgatctccgcaaaaatgaggtggcgctggggcaggttgcctccggggaagggggacacagagacaaacgcagtttggaaagcatcctggtttggtgcccgaggcctggaaagaaatggcggctggggtgcgggggaggtaggggaggaaaacggtgggtaagcagggcctggactcaggaaagggaaccgagtccctgtgagcccgctaagcgcgcagcccctgcccctgtctcctgtctgtccgcaggtctgcgcgtctgttgttcccagcgctctgagaggcctgaaaaggaagagcaacctgtccagaatccccgcaggtccgtgaaagcagggggctgcatggacaggggcccacaagggttgagagtgtggagggcacagtcagggccgaattggggcccctgcccatccccttacctacatgaacacacaccttaccaggctgaaccagtgcagagaaggtggcagggcctgccagggaacagctggctcacgtgtgtgggaggagtggtgggctacgtggtgggcagaaggccctcttggaggcccagtcagcttaggggaaccctcaccaggggtgagatgcaagtagtatccagacctgcattccaccccatgccctcagtctcccatgtctcctctttgtctcctcttccctccacacccatcccccaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 37505 - DNA, 21592 bp, Homo sapiens; identical to SEQ ID NO: 36916

SEQ ID NO: 37506 - DNA, 105936 bp, Homo sapiens; identical to SEQ ID NO: 36917

SEQ ID NO: 37507 - DNA, 3004 bp, Homo sapiens; identical to SEQ ID NO: 37118

SEQ ID NO: 37508 - DNA, 353946 bp, Homo sapiens; identical to SEQ ID NO: 36466

SEQ ID NO: 37509 - DNA, 8863 bp, Homo sapiens; identical to SEQ ID NO: 37138

SEQ ID NO: 37510 - DNA, 20460 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggtgaggaaaggccccctcttcctcccctgccacacgttatcttagtcctgaaaaggctcctgccaagatctgggggtgtgggatttgtgggggtcatttgaccttatagaaccatgccaggtttgggtagagtgtttttaagggcccttattttgagatggtatgcctgagacctgctttccattccctcagggaagtttttttgacgctaagtgtgccctactgtctctcctcctggggccggattcctcaggccagagccaccggacctcaccattcttcccccagggctccctttgtgtttccggcaccaggcgtggggccccctctgggggcgggagactgggctcctccagcgacttccccgcttgaatggctgccgagggaggtactggaacaagtgcatctgggactccctacactcttgaggcaccagattccccaacacagaacactggccatcctgatcagtagactccagctgtgcctctcacaccaccctgggatcatgggacacagagctggtcacccagagctgctgcttaacaccaaaagctttgatctgctctgacctggtagctctagagcctaatgggacccacgagcccctttatgttttcaggacagaaaggaatggggacaggatctctatgtaggttcactttctagttagcctgttggggaactgaggacttgtctgggagcagagggtgattttgtttttctcctaaaaggccggttttaacctggattgtaggaccttgtgtgtgtgaacacagggatggagaactccctcagagggccccgaccaggaaccagtcttaccggtcaggcagcccctgcccacctgctcaggcgggcatctggcttaccagcccagctggggacttaaggctccactgctggcctctggggactgaattccatccgggtggcattcattggctgcccgtggcgggagaggctgggggaggggattgctgagtttctaaggggctttagtctggacaatgaatcacatatcccctcctggaaaggctgcagtgaggcagctctgtttcattctactgccaccgcctctggtcctagaaaacactgagtttctggtggggagaattgagggagtggggaggcaaaatcagagacaaatgcccatttctcttcccccctccagagaaaaccagggcagagaggcctgggcctgtggagccagaactgggtggtgactttgtctttgtcatgctggggttggggagagggagtcctttccagcagtgagtgtgtgtgtgtgtgtacacacgtatgcatatgtgcctgtgtggtggggtctggccaagtttctaaagtccctcttggttctctcttttccaggcctgatcacttgaacggacatatcaagcaggtgcacacttctgagcggcctcacaagtgtcaggtaggggctgggtcagggcagagatgggctgaaggagatgatgctgttctcacggtcgcagccttgagccagccgctgcgtgtgccgggggcccggctgaccgcccaccgctttgcacacctcccctctgttcctccaccctccctctgctctcctcctttgttcttcccccaggcccccttcccccacagctgacgttcctccttcctggttgcttggtcctggttcccaccctgtctttgccttcactctgttgcttggctttcctctcctggtgtttgccggctccttggatggtgggccgtatcacacagatgttgtgttgggagacccggcactgcgctgggcctgactgttggtttccagcagtttgtagggactgcaggtttttttaaaagggctcctggtggtccagccaaccactcttccccttttctgacctcagttagagctcctcctgggtcccctcagcttagggcacaaggcagtgggggaggtaggaggtagggagtgggtggtcccctctcccacactggcatctgtttaacccatcctaagccagggtttctggaggactggagagcaaagtgggctcttcttcttttagctctttgcaaagtagcaggtaggaaacgctggaccagatagattctcacccttggtttacctgcttgaacaatatctgggggccctgctggtacccaaaagattgagtttcctctcctggccactgagccttcctgtgtggatagcgaacacacctctgtcttctccttggttatctcccctctcccatgccaagttcccatcaagtgagggcgagccatgattgtggggtgtgcactgcagtctctgataggataacctgcttctccttatcctgttggtggcaaggggagagggttcagggagaccagcagggagggatgaatgtgccgtaagtagggcagagcccctgggggtcaggcgtggacggtgttcacaggtgctgggctaggcagtctccctggaggatgacccagggtgggcctgctgggatctgtctttgccttgctgccttctctctctctgtctctgattctctcatcacagagcacattctgactcaggtagtgtgctgattagcccgggcagagtaggaggagcccagagggcagtgggggcaagcccggtggcctgggggggtaacctgcactctctgccctttttccaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatttgaggctttgtgtgttttgtccttggtctgtgtcataacactgacatcactgtcccttggtgtacaaatgcgctcctgccctgcccctcccaacatacactctcacagacctgctggcccctcctccagccctacagccacaactcccctaacggacccagcaggtgaagacatgctggctctcttgctctgggctggccagccaggtgtgcctggacttggttaaacagcaggggcacctgttggcatagtgtggggatgctgaaaacataagaggtgaagagacggctctctgggagttcattccttgagttccccactggctaggcacagtccgtatcgctcatcccctcctgatgccagagagaatgaaagaggccagttacagagactagtgccatagcttaagtagaaaggccatctgaatgtaggggcaggaagcctcaggcttgacagtggcatgtctctttgggacttggcctgagtgtccttaactggcccagatgccccaggtactgctggatttatgagcttagtgggctgggacatttcccccacatggagttcaacctgaagctgagaggctggagcagctcagacctccctagcttccacgggctccacttcttgggggctggttagagaaggaatgcgttgagatgggcatatgctcgagaagaagggggccaaagagcccagggagctgaaccttcatgcattgcccttagagttttccagggctgtgggagaaagctgcttgagactacccctgaggctgcctgagttcaagggctactaagggtgggggtgtgcactagtgcccttggtaccacttgggccccattcccaagctgctcaatccttaggaagaaaagctttaggaagtctgggaagggagcaggactggggctcagtgttgagtggtgatgacctgcactcagggtgcctgggccaggacctggcaggcatggcccttaattacagcaggctgtctaactaagcacagggctgtgggccgggcagctcttccgagtgccacaggcagtcaaagcattctgcctctggctcactctcttcccatcagcgtccctctgtcttctccctgtctctaggacaaagaatgctcttctcctgacaccccagcatggaagttctggatgttccctttgagatctgtctccctccgccccttctctcctgggttgtgtgaccaggctctttcatgttctgtgttgtctgaacttctgctgtgcctagactttggactttcacaggctccccagaaaacctggggactgcagcagcagagggtcaatcctggcacagagaagccaacaatcacttcagcttggctttgaacacagggaaagcgtttgtcatgtttgtgttttttcccccagcagcagatttacattcctaattctgtttgctcaggcgaaagttagctttcattccttgagagataatcaatggaggacagggtgggggaagccagcccagtctgggattttaattttgcttagctaatccccaaatggataagccacttgtgggtaactgaagtttggctatccatcatctttaggtagcaaagcatgacaggcaaagcctttagaggacagatcccaaaagaaggttggcaagagaaacaaggcatctctttcctatccctcttgtggctccctctcccagagactgtggaagacaaaatcctgaatatgctttcagcccccgagtagctgggactacaggcgcccaccaccatgcccagctaatttttttgtatttttagtagagacggggtttcaccatattggccaggctggtctcaaacttctgacattgtgatccacccgcctcggcctcccaaagtgttgggattacaggtgtgagccactgcgcctggcctcagccctgttttcttacacctgatccatgttggttcctttgagttctgaggcttagaacacaccctctctcaccattggaggggtggtctttgggtcgctgcctggcaaagctagctcttgtccccaaataaatcaacaggtgtacctctctttcccgggggtgtttatgcagcccctgctctggtttagagactgctgggctgtgtagaggttaggagtttttttctcctactgtggcctgtcactgggtcatgaggtccctggctgacgtggggcccacatgtggccatgagagcaagcatccatggtgctttctgacttcctacatgctggaatttccttgcacaaatctgttcacctttcccttttgggagtcctggctgccaagtactgtacactgtgttataaagtatgagcacctttcactcagcagaagctccctctcctgaatctggagatggtaagagcacaggctctgggactggttcttagtccagctgtctcatatcctctcacggcctccactggcccagctgtaaactgggagagatcagaatcccccagggtgtccaggaggattggtaaagtactggcctgggtgtggtgggggtgggtgtgctagactttctttagtagctgagtcttgtgttttaagcaagttcaccttctgaaggtttcctcatttatgatatgaatacactgaatatataaaacagataaaagcagtatgtcattgctacaaattcagttcaaatgtataatgtttacttaaaaagacaatgacagaagagctaggtaggctgtgctaacgtacacagatatttgggactggggtagtaaacagtggtgtcttctaccttgacagcattgcatgcgtttgtttcttgctatggctgtacagtaaggagacagttagatgtctgtatgtgttgacagtgttcagccacttaccttgagctctcaggttctcaggatgtgcttctgttaaagagagatggcagaggcagttccgttctagcacaaggtaatggggtggtcttcagtgggttaccatttgatctgtgacacaaaggtgaatgttgctttctcttacagttctaaaacagtaaacacacacacacacaaaagaaatgagtcaaaattgactagaacccatgaaacacctccctggaaccaaaatagcttgaaagccaacggattcagctcttctcagggctttcccaatattctatgacccccacagctggaatgcctttgtaagctccagctgaggaagggatgttgtgaggagactgatcactggtactaagtcaggtgctcaggtacaggaagtgcctgccaacctgagtcctccttccagggtgctggttctgaccttcagctcctgactcatccaaccccgggggcctggctgtgagttggtgctcagctcacaccacagctttccaaagccacgctgtcttggagggtgatcacacagcttgcctcggagggctgctgtcaggatgggttgcatgagataagtgcctctaaaaggctgagcaccgtgcctgcctggcacacaatgaatgcttaatcaatacagggtagtatcatcatccttgctgtcaccagcacttccccagcttaacgtttcacaaatgctttttttttttgagacggagtcttgctctgttgcccaggctggagtgcagtggtgtgatctcggctcactgcaagctctgcctcccgggtttatgccattctcccgcctcagcctcccgagtagctgggactacaggcacctgccaccatgcctggttaatttttttgtgtttttagtagagaccgagtttcaccgtgttagccaggatggtcttgatctcctgacttcgtgatccgcccgcctcagcctcccaaagtgctgggattacaggtgtgagccaccgcgcccggatttttttttttttttttttttttgagaggaagtcttgacttgttgcccaggctggagtgcagtgacacgatcttggctcactgcaacctctacctcccaggttcaagtgattctcctgcctcagcctcccaagtagctgggattacgggagtctgccaccacacccggctaattttttatatttttaatagagatggggtttcaccatgttggccaggctggtcttgaactcctgacctcaggtgatccacccatctcggcctcccaaagcgctgggattacaagcatgagccaccgcacccggcccacagacacttttgaagcctctggcccttgctgtctgctaattctcatgtcgtcagaattgccactatcatttaatgggctgctttttcaattcaaactcgtgaaaatattacgaataattatctctgcactttgtcctgcctttcctttccatttccctggccaagactaatgtcacttttgaataaaatgaacaaatataattctttgtataaaactaggggaaacccagggatacagaacaggaaggctggtttatatgccaataactcatctgtaaattcatgtaaatgtaattctgtgcattatagctaatgcacctaaagtcaattcttaatgtctaaggatgagcaaatgtgtaactcttcattgtgtagaggggtatagagcttagcttgccatgtcctgggtacatttccagtagtcatttagttagtaccagtgattcccactcaagtgtcccgtaaggaggtaccatgggaaataagagcagcctcttggcattctgggtagggagcctgagccaaactctaaagctgtctttataaagggaggtcatgtgatggccagaaattgcctttgcttcatggtgcacttggtggggagtcaggtgtggggtgctgggtttcacatcatcccattttcttttctgccttcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagcttttgctggttgattcactggcatatgaaattcagcagccagggaaggaggttgagtctggagataaacaaggagcagacactttgtagcacaagtagtcagaagagagcccaaactcaggtagattgtggccttgagagaggaaagtggaaggtgctctgagcagggcagcatgcttgaggacaaggtgggcctaagtagtgtctaactctgtggcagtggtgttgtgttgggtgaagtcaagcctgtccccaaggttctgccgggtctagttggctgttggaagtgctagatgtttgtgttttgcaagcacagcatcagtggaggcttgcactgtgtctgtgctaaaggaggttggagcagctatctgtgaacgtgaggatgcttctgcatggtgtgctttgctttggccagtggggagcactgggatgtccttatctcctggggcattcttgcttgtcccaatgcttccgaaagcctgcttagtgggtgcagcactgaaccaggagtcaagagacccagggtttagtcccagcctctcactaggtggcctcgagttctcccattccctctctaagcttgagtttcttcatctctcaaatggggttaagaatagccccctttcccacctcacagggctgttatgaggatcccaggagacaaggtaggtgaaaggagccgcacacttgggagactctatccttgcactttgtaacaatgttgggaaagacatgcttgttgacactctgggttggaccaggcacaacactcctgcaggccttggcggaatcgttgggtgcctgtgctgtgttcatgtgccgaggtccacggtggaaggagattgctgagtagctgggtgttcttggtgtcctggaactgggtccctccttgcagcttcatacctggggtttgtaccaccaggacacctgctgtgaaagcagggaagtagtagtgaaggtctcttaagctgtctgttctgttttctgacatgtcattagagcccattgctgacaggagcttcctccaggttgcaagcggtgggcttgcgcatgcagggagagttatcaggctgtggctgactgtcttgactggggcttccccagccctagaaataatgtcgtttcttgtcttgcttcatcctaacctggcttcctgacagctcccccggataactcaaaacctgctgtaacaagctgttagcaggcattttgtcaagttttcaatatggaagttcccagtctgagaactggggtcagagaccagaggttgaaaactgctgagtggagaagggtgctcatgataaaactcagaaagcccagaccagatggtggagtagggcagaaactggacaggagacccagggctacagcccttgaagcccagctcaggaggagagaaaaactgagagcagcagggacagtgggaaagttggcccagtaaggaagcagctgatgtggcaaagccaacaactattgtacatcaggatttattttccaagggctagtaaagagaacttgggcaacagccataagctacatgaccggaatggagaatccagaagagtaaaccagagtctactttttctcagaaaagccaagactgggtctggatcacaggccaaacatctctgggttccagagccagagcgggaagtccctttcctgcaagaagactaaagaaggtgctggtccaacccatgctgggtactcagaaagaagagaaaacaattgcagtttttatcagaagagaaggagcaggattctactcctggactcattccttgggcagaaataggaagagacaaaaaaaaaaaaaaaaaaaaaggaagaggataaagttctttctgagcaccaaaaacattgagacattggaatcaaaatgcagagagctctgtgtcctcctttgccctgctgccaccaagcctgtacctacaggaggggttgcacgaataaacgaatgttcttatctctgcatgtgttcaaacaaaggctgaatgtcagaacagttaagattgaatcaggtgaacttccaggtgccctcagatccttcaatcccaacaattcttaaatagttgacttaagtatctacctatagatctgtctttttcaatttttgccacaaaaatgactcctggctgtgaagaatggcaaagaggaaaggcagcctgactcctgcagcctcacacgtgagtcagatgcaagttgaagagacagatgactctggctttgtcatacagacatatcaggatgtgtatgatactatttgtacaggaagatcatttgcagtggagggagtattatggctagaaaagcttgttcccacatttttgagttgaggaaatcagttgagttgaacagtggaaaagggagaaggccctggctgatcaccatgattttcttcctttaaagtttctgtagcaggatctttgtatatatgcctatgtgctggtatggtgaagaggaacagattatcaggaatccgcctttgacagagacatttgaatgcaaacatcattgcttgaaaggtagaggaagccttctccccagtcagaggtaagcacacaagtggatggatgcagggaacctgctgttcccctggactcacatcaagctatgtaggcccactccaacacagtgcagttgggaatggccccttcagggtttggacaaggagaaagcagtccccaacccctgcattgatgtggaacctgccaaaggatgatttgcttctggagtgccaagtgcaggcacaccaggcaagaaaatgcaactgaggagcagtggccttttgctaataagaccatcgtctctggagtgaaagggccggtggcttgttggttgtagtggcagtcatatgtgtgctcagcatctccattgcgtggatggctggatcaagctgcctctttggatcttggttaatcagtggtgaatgggtgggtaagtttagaattccggctaaatatgtctggcttcaaagacgtattctgctcagaagctcagcttctgtttcatcctaacacttggctgctgagttgctctgtgtttaaattctaggctttaagtggcagctgtggatccactcctaccaccccgccatgtggttttgctatagatagtacagtctgcagctggggtaaagtcaagaggactcagccacgtgtttctaagactgtttttcaggaaaactcagcaagacagtttcgctgttgttgcccagactggagtgcaatggcgcgatctcagctcatcacaacctccacctccttggttcaagcgattctccttcctcagcctccctagttagctgggattacaggcatgcaccaccacgcccggctaattttgtatttttagtagagacagggtttctccatgttggtcaggctggtccggaactcccaacctcaggtgatctgcctgcctcggcctcccaaagtgcatgagccactgcgcccagccaaactcagcaagtttttattgagcatctgctgtgttctcttggtatagctctcccagtaaggagtaaacataataattcctggtgctctcccgctcctttctgtccccttttgattgcagtggacctgctctggttcatcacagggagagagcttcatgctattttagagaccccacaagggattaaaaaactaaggaaaggccgggcacggtggctcacgcctgtaatcccagcactttgggaggccgaggcgggtggatcgcgaagtcaggagatccgagaccatcctggctaacatggtgaaaccccgtctctactaaaaatacaaaaaaaattagccaggtatggtggcgggcgcctgtagtcccagctaccagggaggctgaggcaggagaatggcatgaaccctggaggcggagcttgcagtgagccgagatggtgccactgcactccagcctgagcgagagtgagactctgtctcaaaaaaaaaaaaaaaggaaaaaattaccttctaaagtggtatcatcatattatcagaaagttctaatatcttgtactgattggtgggagccaatgtctcctggttctgctttgttttaggggactctacagtaccaccccaaggggcagggctaacagcctctttcccattagccttgtctcctcactcctgactacagcctccctcttagggatgtctacatgggaccctcttacaccaatctatacccatgatcagcctcaggcagaccactgcggtcatagcacaggacaacttgctctaccaggcagggcaggacaccagcacctggtctagacagatctttgaagtagctgtattgggaaaggaaggaaaattggcccaatcccacatttcccttcagaaccactaactgctgctgtcagaggagaacttgttaaataaagttcccacaggccagccctgtttttccagcagcttccattctaacataccattatggtcgaaaaatacatgagtgtaaatggtaataatgaaacctattgtaaaagtccactggatatttctagggctcagggctaagacacaggaaccaattaacccatttatgctggaggttacaaacttttttgtgaaaaatcagactttaatgatgatcttgagcagtaggatacaaataattcctaaaaggttagcgtcccaataatggaacatgaggcataagtgggttaaagcatctgcccagtagctaagggccaagttctggtggcacatgatcctggggttggagtccaggctctgccactcagtagctgtacgtgtgaccaggttacttaacctcaccaagcctcttttttttttgagacggagtctcgctctgttgcccaggctggagcgcagtggcatgatctcagcttacaggtgcctgctaccacgcccagctaattttttatatttttagtagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatcagcacttcctaaaggtgaacctttattacagttccagcagcattcaaaataccatgccaattcagacttttttaaaacaaatctcatgcagacattacacagtactcttcagcctctgaccctttaccctttagcagtggatctcactgttatcctgtgactgtgtaattttgaaagtgaatggaaacacctgatgatgagtcaaccagatctgaagtggattaaagggacactgtcagggtgctggcaccctaagtgggccttatactaaaaagcttcagttcctgctaaaagcaccttctgatccttgactacagtggggtttgatggcatacctccttcctgtgaaacccaagtcaaaatccttttatcggcctgcctgattctgtatccttggacgcatggctgctgtggaagttggcccaagatgtgttcttcccagcctgagatatctcgtggatcagactgaccgaagcatctgggaggtgggctggaacagtcccaagaaggccggattgtcctcccccaaaataaagacagagatcatccgtgtttcttctcctgtacgcgaacctggtggatgctccaaaatcgaaccaaaacactaccatgaataagagatgactgcactcctctgacacaacttcctatttttgtctttgttcttcaaaaggtctaaacagttactaaatcctgttatgctgaaggtggggaagttagaaaaatagaacatctcctgacaggtagaagacgggatccttggaggcgttcctttgggatttcattttacctccatctcgtttgttgtccagtttccttttacgaggattaagcaggcatcctgctggctagaatcctgtggcttccctggagcctcaaattcttgtctaaccacatttctagtcatggttcctgcaggagacatccactcaaaccacctgttactgaggcaccaagcaaccctagaggcagttggcctctggccctagcaggagcaggatctcaggccatcccaccaggcagccagcctcagcccctcaccgcagccttgcagagtgggctctgcagagaagccgatttgtggacagtgccaccctccatcctgagtcacatggctcatgtggttgcagccatttttgagccaggagggggccccttctaggtgcagctgacctgggaatgctagccagagcggccagaggagaggagttgggggaaggagagaggtatctcttgctggccgcgggatctcatctccttttgtcttgtttaggtttctcctctgcctcctacttaaaggtccatgttaaaacccaccacggtgttccccttccccaggtctccaggcaccaggagcccatcctgaatgggggagcagcgttccactgcgccaggacctatggcaacaaaggcaagcgaccccttgctctgcactttgcttctctgcgcagactgtgttgtgggggcgctgggctgggcgtggggaggcgggaaggctgccggctttctggctgccttgaggagactcagagatctgagtggcagtggcctccaggacaaaagtcacagtgggtatctcactccagggcagtgagtgaggctttagggcactgccgagatccagcctccgcctcctcttccccagccctcctcctttcctcctggccagcccccactgtctggagccctgcagggatgccccgggccctgggcagaagaagagccctgcatgatgagtcactatgggcctgtcactgcctgctgccctttaggatggtgtggagctgcggctgaatgctttctcctcttttgacccagtgggccggtgggagccaatgtctggcttctctcacagtaggagtggttggttactgtgagtggccctttctggagagcctctggctatggttgtgagatgcatggcaataatgagctatctgactcctctgacttgggagttggtttgcagaaagctccccaggcccaccttcacttgttgattcaggttgttttgtggtatgtcacgttgtcgttgccttggggatgaggccaggggcttggcagatggtagaaacagcagagatggcatgctccatgctcccatcacagacctcccttcccggcatggctctctggacccaggcaggaagctgctgattggtggaggactccagtgtgggccgggcaaggcagagcagccagggttgtctcttggcccagcttgtctggggcctagggtggggacacccagccgactgagtagtacagagttgctttcaatctctgtgcttgggctgcttggccctgaaaaggttttggcagaaggaaggcggtaaggacagggctatgtttgcagcattaggaaaaggattggcttctgtctgagccattgatggggtctacccaggttgaggacctaatggctctggttctgcctgtcttgctagggtgcagctagtctggtgcaggaggcgaggctactattacactggctcggcatcatcagaataccaattttaccctcagaggcacccaaaagagcgcctaggagttgggggtctttgagttgttctgggcagctgtagcagagttgccctctctgtatcccttccttgaagcaggctgagatgacggtgagcagtacatgtgcagctgcatgaagagtccacagcaagggaggctggcagccctagggccctgccgtttcacccctgtaggcactccaggctcccagactgaccagctgaccctccgtgggttctgccagggcagtggctggccaatggctgccctccacaggtctgtgagctggcccctcatgacccctccaggagggggcatctccagagcctggcctcatcgctctcctatattttgttttttcgtagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 37511 - DNA, 74900 bp, Homo sapiens; identical to SEQ ID NO: 37038

SEQ ID NO: 37512 - DNA, 15850 bp, Homo sapiens
gtgcggagcggcggcggaccacctccaggtggggacggtgggtgggcggggaaggaagcggaatacacctgagcgggctgggccggggggcgatggaataaaagaagatggagagacttcagcgcctgggactcgggtgggcgaggcggaaggtgtcctcgcagcacggcttttctccgcgccgcggttggttagcgagtgccctctgggtgctaggcgttgggcggatggtaggatcgcggtagcatacggatccgagtcctgcgccgagtgagaggagaggctggcaggtagcctggcatcccgaagactggcggcgagggctgggccgggggacctcggggcctggagggctgcgccacctgggagtccgggcggaggggccttccgctcgcgctgggagggatcgcggggccgatagggaggcctggacttgaaggagccgaccgtggacgggcttaaagaaaatgcagtgtttgatgttgggtgttgcagatctcttactcaagggaattctggtctggctgctgaacacgaatgctttacttttcccttcgttctgggagggtttttttcttttaaaggccagaagaatcaggctgaagaactggtcggtatcagaactcctgaccattgcaagcctctgttgctgcggcgtaattagaatgaagggacagcaatctggggctgaggagactgaaaggaaaagggaaataatctgttccttttgcatcataaaaggaaaaataatgtatactgacatccctgtgttacagcagagtagatttggaggtggtgtaagtgaagaaaacaagacctcagtacatagagtttccaaactggaaagtttgtggcagctcggtacttttagaggaaaccctctggaagttatttgtctttatatcactatcattttttaaagtttctaatgattgatacctagtaaataataactgatccttgatcatttacagagtgcttttccattcgttatgtaatgtaattaattagcatggggtggtactcagaatccctcatctgcatataaaacatcttgagagataacataacgtggtagcaaagagaaaggttgtggaatgtacatcccagctggttttttctgttattgttgcttgctactgaacaagttatttaaatactctgacctcagtttccctatctataaagtggggagcatagaagtacctatctcatagaggtatagggattagatgaggttatacaaaaataatacctggttctcaataaatattagctatcattttctatacttttaaagtagggcaaaaagataatggtagactgagttgttctaagcctaatattgttattataactgagttttaagaagaagtttctttaattctgcaaggacaaagtatttaagtttctgtttgaagcagtggtacttaatttagggtccttgggacccctaacttcagggcttataaccccttaaaattatatgagcttgtagaggcactgaacatttttaaaaattcaggagttgacgacttgaagtagtggtgaagaggctatagaacttggcagaagttcacgtactttgcaactagattgtgtgtatttgaatcctagctccagcatttatttactcttatgaccctatgcaagttacttaaaatttctgtgcccagcttcttcatctataaaataatactagtacctacctttgaggcttcttgaaagggaaaattagttaatatatttaaaatatttatattacctagtatatattaaatattactatcaactactgtcagttatttttcaaacaaaaatcaagtggcacctattttatcttctattgaagtaattttgacgcatttttgacggccttaacagtgataatcatatagatgctattttattgagtacctttcttgggtcaaatgtcaaaagtctacttagtctctaaacctcacagcaatcaaacatgtttgtgttctttttggttgcacgatactattctaggtattgtattgaagtagggccacatggcactgtggggaacatgtagattggctcatcagctgttaccaacctttagtgatatagcaatatccttttcaattattaaatgtttatgttatctgatattacgtagtaccctgtccctgctacaccacctcccttggcagtcttcacccctataacttcaactactacctgtatactaaccaggctcgcttttgaacttcacatttatatttacatgtggcctattgcttatatctaagatagaagatgagccacagataattaggttttaagatctacattgaacccgttttgaaccccagatatctgagacaggtctcagtcaatttaggaagtttattttgccaaggttaaggattcacccgtgacacagcctcaggaagccctgacaatatgtgcccaaggtggtcggggacacagtttgcttttatacattttagggagacatgagacatcaatcaatatgtgtaagaagtacattggttgggtctggtaaggcgggacaactcacagtgggggcttccaggttagaagcagataagagacaaaggttgcattattttgagtccttgattagccttccactgaatgcacacatttcgtctggctcagtgaatctgcatgtttacataaacaatagggcagaggaagcaatcagaaatccatttgtgtcaggtgagcctcagagggatgactttgagtcctgtctgtcctttatccacaaaggaattttctgagggcaaattgtgagggagggatgtagcttctcatccttgtagctgtcttatttaggaataaagcgggaggcaggtttgcctaacatagttcccagcctgacttttctcttagcttagtgattttggagtcccaagatttattttctgttcacaccatcattccttacccaccccctattcctaccctacccaaatctgctagctctgccagtattccctatttcaattacaatgacatcaccatctacttagaccagctaaagtctcacagtcatcctagatttctctctctttcacttcccagcaaacgtgggttatccaaatcctgtgggtgtttttacttgcgcgaaatctctgctggctagtcttaacagccactgcccgaggtcaggctatcattttctctgggttattctaccacaggaacaaccaaactagtctccctgcttctcaccgataacccatatttcttttctttccttttttatagtgacggagtcttgccgtgttgcccaggctggtctcgaactcctggcttcaagcggtcctcctacctcagcctcccaaagtgctgggaataagcattagccacttcacctagcctagtagtccagatttctaatggaatggtttttatgaaatgtgggtctgattgtatctttttcctacctagaaatctttagtgtctcctcatagcgtgtgagagaaagtccaaattcctcagcaggacagcagatccctccatgcgtagtctaacaaatctcctttacaagtccatcccctaacatgtttttccctctgctccaccccatcaccctgtctaacacccaccaaccacacgcagtgagccatgaatgcatcatgctcttctcttgctttgcagttgtgacttctctttggaatggctatccctaaccttttctttctggtgatgtccttcaaagtccaaatctaatatcatattcactaggaagccttttaccataagctgaggtagttgtgttgtcttttctgatctcatagaatttgcatatatatctgtattgcagcacgtgtcctattgctagaattgtttttgtagttgccctacctttaagactgatttagactgtgtctgtttaatgtttgtatgctcattacctagtgtggtgcttaacaataagttcttatttgaatgaattaacaatggcatgtatgatgaggaatatatgttaatatctggcatttggtgctaattaaatttttcttttcctgacaaagtgaggaaatgttcataattcatatcataaacaaagggccaaactccctaatatataaggagcttctagaatttgacttttataaagatactaaaaactcagtgggaaaacgggcaaaggataaaaacagataaacacagaaaaaaatataaattattctaaatatatggaatgatgctcaactttactcataataaggtaaatgcaaattaagtatacccgagatagcccttctttcttgatgaatatgtgaaagtttgatgatatcccctgctagtaagattgcagagaaataggtaaggtactgtcctacatcgtttgaggactacaaagtagttaaactcttatggagagcgatgtagcaatatctaccaaagttatgagtgtataactctttcgctcagctcttcttttagaaatctgcctaatgagggcctgtcattgtagcattatttgtaatagcaaaaaatggaacctatccaaatatctagatatgtgttaagtaaacacctatataacagtgaattagacataattcagttgaactcacagaaatggacacaggtccatagtccctagtcacaatttggaactctggaaagccctgtaaaaccaaaaagttgttttctttttgctttaagttcggctctcaaaatcatttgatgacaaattctcactccatctgaccgaggtgcccattgtgtcttggcacacctaccaggtattcctggtgttttttattgttttgttaatttgggtttaacgtggcagtgtgggaactaccaccacatgtgacttaaagaatagaaaaacagatcgtggacgttttatagtggtagtaaggactaagaattgatgaaaaatagggagacattgcagaggactgaaaatgaagattctaaccatgtttcggttaagtggatttcacaataggaagtaaacagatgccactcattgctttgttgatgatggaaaaagctggcatatatgaagacctgctactgaaggatgtatttagtattaacaaggaagaattcagaaacttaggaagcagtgtggtgaaaaatatctaaaagtatgacaagagttaattgaaaatttactttctagacagctcttttatgcattctcctcaactgtaggttatagtttttaatcatttacttttacttcactgtgaccagaatacagcctttttctttgggtcttgctctgttgcccaggctggagttcagtggcacgaatatggctcacggtagccttgaactccttaagcaatcctcccaccttagcctcctgagggtagctgggaccacagggctgtgcaccacgcccggctaatttttgtatattttgtagagatgggatttcagtatattgcccaggctgttctccaacctctgagctcaaggaataagcctgcctcccaaagcgctggtattacagtcatgagccaccatgcctgaccagaatacaatctttttctccaaggagtgctacactctgggaaaaagcaagtatattgcttgcacagttaagggaggcctaggaatcaaaacttcctttaagagttcagttgtaaagatcctgttgtcaaaattacttaatgcttgaaatgatgttgataaatcagcaataataaatgtttaacattttagctgacaatgaggtttgaaaatgaacctgtagatattttggaagattttctatcactaatgaggtgatgatacctaatctctttaattataccatacatttaatggcccaaaccataaatacgtcaggagaagctgatgttgaagaaatgctgaacattaatcctgatgcttctgttcggcactttttgggtgatggggacattgctgaaaggtttctaaatgcacataattgtcacgcacgtccatgtgaagagaccaccaaacagcctttgtgtgagcaataaagcttttttaatcacctggatgcagtcaggctgagtccgaaaagagagtcagcaaaaggagttaggggtggggcagttttgaaggatttgagtaggtagtggaaaattatagtcaaagggagttgttctcttgcgggtcacaaggtgctcagtaggggagcttctgagccaggagaaggaatgttacaaggtaatgtcatcagttaaggcaggaaccggccattttcacttcttttgtaattcttcagttgcttcaggccatctggatgtatacgtgcagacttgggctcagaggcctgacaatagcgggaagatagtaataactacatgaatgattaaatgatgactatattgtgaacacagatgggaagatcactgaaggcattatgtaaataatcattgcttaagcagaaatatattaataagacagatgacattggtagaaatcttttgaaaaggttatcttggatattgttgctttatcacttgagaatcctgatcctggcccatgaccaatgtctaattccaacctgataggcccttctctttaagattctcaagcaatcagatgtaatgaacatttattgcgtgtatgtatacatatacatgcacaagtatttaactttgattttatatatatttgaaagtttactgaatttttcttttaaaaagagaatacattgtttattgtctgtaccagtctattttccatttgtcatttgttactccatacataattacataaattgttaatatacaaatgaattataataccatttacagtatgtacttatcccacttaatgtgaatattcacattttctaaacaaatatttgatatgagctggtcatggtgactcatgcctgtaatcctagcactttgggaggctgaggtgggtggattgcttgagtccaggagtttgagaccagcctgggcaatataatgagcccttgtccatacaaaaaaattttttcttaattgactgggcatggtggtgcccacctgtagtaccagctcctcaggaggctgagtcagaaggatcacttgagcccgggaggcagaggttgcagtgagctgagattacactactgcactccagcctgaatgacagagcaagaccttgtctctaaatgaataaataaataataaaaaagaaccaaaacccccaaatatttgatttatttaatgacagggagaagttttgacctttgcaaaatgtatttataggaattttgaattccgaaataacatctgatgccaaatgttttaagtaagaatggtagtagacctgtattataaaaaaggagatggtgacttccaaaacagcagagtaagaatctctgaaaatctcttctttataaaaagcaacaaaacactgacagaagttgtcagaatcagcttttttagagctctaggaattaaaactttatgagttaaagctttacaataatcttagcagcctttatttgagaaaagtagttgaatctcagtaagaacaatgagctttggacattttccgtcctttaccatctcccttttgctgacttcatggtagccttgaaaactaagccttacaacacagtaactatgaaaaacagcagcctggatggaaggtacagaataggtttgcagcctcaccaaaggccacaacccagaaaatcatcaccacttgatctctctggcaattctcaaggcttgtgtttatatgacctgtcttagagcttgttcaatatcatcctgtcccagggtgttttgtcaaggagagtcattatttacacataacaggtcttagaggcactattatcagctggcactaacaaaagcctgaccaaaaatacttaaaagggaatactgagaaatgagatatccctagggggctttgaaaagctctgttttcctgagaatctagaatgattcccatgagcagggctgttgcacatacccaagaaaggggagaaggccctaatttcccctttggctgaccttgagggtttacgcaagcagtaagttcaggccagtcaattttagagtgacaactaaagtattgaaagcatggcccaacacagcaccttggcaaaggctgggggacttaactggttcaaagcacttaagaaaatcactccagtcattagtaagagacttgtagctgcacacaacaaataaaacaggtatgtaattagttcagagaattacttaacgcacagcaacaacaaaagcaacttaaagccctggggcagggtgggcggtggtgcatacaatctgatttcaagagttaccccatcatattacttaaaatatcccattttccataaaaaattaaaaaacacaaacaggaaagtatggcctgtacacacaaaaaggcaatcagtcagtagaaactctctctcagaaagcccagatgttggacttacaaggcaaagactctaaatcagctactacaaatataaaagaactaaggaacaccacgtttaactaactaaaaggaagtattagaacagtttcttcccaagtagagaatatcaataaagtgataaaagttttttttttttttttttaaagaaccaaatggaaacgcaggtgttgaaaagtacagtgactgaaactgtcttgcttaacagcagatttgagccaacagagcacagaactggaagataggtcaattgagattaaacagctgggaagagaaagaaaatgaagaaatacaaacagagacttggggacactgtcatgcatttccacataagcataatgagagtcctaaaaggagaagagagaaagtcatagaaagtttaagaaagagtggccccagactcaccaaatttgatgaaaaactttacacatcctagaagttcaacagtatagggttggggtttatttttggggtgctgaaaatgttctgaaacttgatagtggtaatgattgcatagctctgagaatgctaaaaaactagtcaatcatatactttagtgaattttatggtatgtgaattatatctcaataaacctgtttctttaaaaacaaaaaaaggaggagcatgatatttatgtagggatggaaagatctccaagatatatattcaattaagaaaaaggaacttcatggtgtatatagtatgccatgttttgtaaggagggagagaaaaatttgtcatcattccatcttacattaacaaacaccgtaaggattctcaggaaactaatagatatggtcacccagagaggtggaaatgaaatgacggtgtggtttacagtgacatggatggaagcaaggctttgcattgtatgtcttttcctgtcagtttctcattttcttaaatccctgtgggaatttagtggagaaatctcatagggaatctagtgaaggaaataggctacaaagaagtaaataagtattttcagaattttccttacctgtgggctattttgtttcatgaattgatgtttattaacgtggcccaatatgtaggagataaaggccgtttgaacacctgaaatctattgtgggtaggcaatttgcagattggcttcttgttcaaaaatttcagttcaagtgagagacattttagatgctgaacacgttttcttgtgcgaacaatgcaatgagggatgagtgagtcgatcataaatgatagattccatagtcagatcacaaaagctgaccacaatatcaccgaactgtattgtaacaggaccatgagtatagaatggacttaaatatgtactgaactgactaatgttttttagagtttaagcatctgaaacaggagttggcaaactatctgtaaatggccaggtagtaaatgccttcggttcaacgggccatactgtctctgttgcagtgatactataagcccacctttgtagcagaaaagcagccacagacagtatgtaaacatctgggtgtcgctgtgttccataaagatttttacaaagcaggctctgagtttggcccgtgggctgcaatttaccaactcccgatctggaatattgattagaggtagagaaataaatgtattccagttcttaacaccaagaatacatcttcctttgttctgtcaatgggagtgtcagaagaacagatagtcccaattctatggttgtggtggcagcatggatatcttttagggaatttatcttaggtgtcagtgctgaagcaaaaatctctgaagtatgaatccttgaaggagagagatgagctgaaacttgtagctgaaagaggaaactatttgtctgagtacctagtcccctgcattcccatctttaccacttgccatgctgccataggacgcggtagggaatgacactgaaatggaattccatctgggcttgtgccacttagcagcttgatgacctttcctgggcctcagtttctctaactgagctttagcatccccatacatagtatgaagagattggactagagatgatatctaagatcccttctggctctaaagatggcatgtaggggattctgatagcagcagatgtactgcatatgactgttcttaaatcaggaacttgagatatagtgtttctgaaaaatttttgcctggaaaaatagagacatggtaactaattgtcacacatgcttattttttaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaaggtaagaaatgtttttacctattttctaacgattaaagtaaaaataacaatatgatatatttctgagatttttagattaagctgattatatgtaaccattaaataaaattttggagaccaaccacaaatgggttagatattttcatgagggttaatccctgctctccttcccttagtttaagcaaatctaactttttaataaaactataagtctagtatcgtatcttgctagatgcatattggagcatttttatgctgatattgatgagtaaataaatgcatacatttatgtaattattttaatatatgattttcacaaactgaaatgtgtttttttaccatgttttgttttttggctagataggggattcaaactcagtagttttaaagttgtttacaatcatttttaaatttcggttgtttgtacttgtcagtgactccaaggactgaacagcaaaaagaaaaaatagagaggattggggatggaagttaattaggaaagaaatggttattccataaatagaagtttagaatgcagattttggaggaaggaaaaaaggtttcagaatttgaaatacttattgcattttctcagtacaaaaggaatgattttcttacatacctatttttatgtatttaaaattttaatagaaacagtttggaggtaagccccttcatgtaaaagagattttaaaaatccagtccagaacagttttatgctagttttgtttaacatggattttgtgatttttaagtattggaaatttcactttcagaatcaagtccgtcgagagattaagtttactgtccaggcattgccatggataagtattcttactgttgcactgttcttgctggagataagaggttacagcaaattacatgatgacctaggagagtttccatatggtaagtaaataacacgagtgtcaggaagagagtagtctaagcacaggttagtttccttaaaaaaacaagtctgcccttttttttttcatcttttaaaataattacaaattattcagttgttttttaatgttctattttcatgtgttcatgtcttgccacatgtgcatttctttagtttttctatcaatctgaaagtctgctgtagatgagattgtgtctggcggaagattggagtgatcagagatgggtccttgcatttgttttctattaattattgaattcaaccttctaaaaaaaacttgagtagcttatgtcattgctgaaagttaaaaacagatttttaaaatgcattattctgcttcttagaaactgtaactcttctggcatacaaccacccacttttctgtgcctgtatacttcattgtttacattacacaaatgaagtcctgaggtgcatagtggtttgggctctgaattttgtttctcttagcaacttacatggttgtattttcatgtcaaaaaaatcttgagattatgtaatatattagtcatagtactgtgcggatattcataagttatgtaaatgatacctaattgttagaccttcagattgttactcttttttgtattataaacagccctgtagtgagtaaacttttgtgaaattctgaaactttttcaagatacatttctaggatctagtatgtaaaaagcaagaatcatagtatttattgaaggctgatatgtgtcagtgacagttctcagctcttcacaagaatcagtccattgttttcctacaattctatgagataggtactatcactgtgctccttttataggtgagtcaatgaggtgtacagagagtttcagtaacgagttggtggtagatctgagacttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggcgacagagcgagactccgtctcaaaaaaaaaaaagaaaaaaaaagtcagttattcagaagaaggaacaaaaaattatatactagagtaatgaattggctgggctttgaaaaatggatatgattatgagttaaaataaagggagagaggacattttaggttcttgaacccctatgatgaaagatacagaggtaaaacttccaagacagtgggaggacattgagtaaacctgcctggttagagtagaaatacaggagtgatgaggttggaaagatccgaaaggggtggagtatggaataaatgctaaatttaaagtatttagtggaaagtatattttaagcagggagataatgtgtaaagatgggttttaggaagattaatatgaaggaagtgatgattcccagagatttaaataataaagatgtcttaggagtatcctgtctcacaaatatctttatagtttaattaagaagtactttaggtagaacatttcaagtacttatgcgagggaaatgaggaaatgaccagattccaagaagccaagagagattagtttataatatactgaattagccagaacagatcatttataatgtttgagtctaggatcccattttgcactcagatggacatgtgaaaagtgaactctaatcccaggagctgagttttgattcttctgtttcccgttttcttttctaggattgtttgaacttgtcgttagtataatatctttcctctttttcactgacatgttcatctactggattcacagaggccttcatcatagactggtatataaggtaaagtcatttgtggtgaaaagagaaaaaaggttacacatttcagcaatgtatgattataaattctgttctctatttccaagaatttcctctacccatattaaatgtctaagtagccataatcataacaggtacagggtgcattttgttcatattcttctttatgggtctaaggggctgtcttaaaattcgtctgttccggtaacaggtacacatggacttacagagggaacaatagacattagagactccagaaggtgggaggatgggagaggagtgagggatgagacgctccctattgggtacaatgtgcactcttcaggtgctaggtacactaaaagccagacttcaccactgtgcagtatatccatggaacaccactgcacttgtactcataaatccatataaaattatactgttttagggcgaagaaggacattttatagaataaataattttgctgatctctacaggatttgttaggttgtttccaacatgagtgtgagaagctaagttgaatgttgcacggggtaaagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgta

SEQ ID NO: 37513 - DNA, 23807 bp, Homo sapiens
atttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacgggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgatttttaaaaagagatcagtaaggccaggcagtggtggctcacgcctgtaatcccagcactttgggagactaaggtaggtggatcacctgaggtcaggagttgcagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 37514 - DNA, 283882 bp, Homo sapiens
attagaaacaaattttggtcggtgctccctgggctgctggtcttctttaccttccagctgctcacagaacagagagtttctacatacaagcagaagatgtgaaaatattgggaataaataaagtatatgcttataaacaagtaagaaaataagtatatgtgcgtgaatactttatgtgtgttatatacgtataagatctgggagcattcagcaggtattggtaattattctatggtattatgttattataatacagctatatctctgtttagctgcattgaatcctataattaatgcctcctatattgagctaatgtaaaaggtattgactctcattgtagttgtgtttcagaaagatttagggcagggaattaaataaatttagtgcagtgtttcttagaattaatataaacacttaattggaaatatttaaatagagttgatggcagctgaatcgatatctcccatataaagacttgaatgttcctttgataattctgatatatagattttttttaaagtaacaaaagaactagaaaatactttctgcggactccttggagaatcttcaagaatttgatgaagaattcttcacaacatttctatcttcctagaattaaccactttagagtctttcaaggttttggatctatttcacgagggcccactcatccttaggttctgcttagctcagagtggatttacaactccagaaactgtctccccttcccaatagcctagtgtactatcaatttgaatcagtgttgtatgcatttgggcatgtgtgcaagggcactttcgggcccatctgtcttatgtgggaatagtatgcctatgtctctttatgtgtaacctaacagtaaagttgaaagtatatgatgcacagttgcttaggtcttagcgtataggtctctaaggggctgtgtgtgaagctgtggagatacttagggctgttgtgtggaaaggtgcctgaaagtgagaaagactaccggctgcccaaggtaggggggatgattgacagcagacagccccgcccctttcccctccattctttcctctcctgctgcatggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctg

SEQ ID NO: 37515 - DNA, 10575 bp, Homo sapiens
tagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagtgagtgtcgggcgccaggtgggctccatgcaggtcccgaaagcccggcggggtctgtgggtttagtcacgtgtcctccagaagcgtgtgaccttgcgcttgtcctggcgtccggaagcgtgggttattggttgtgtccgtggaactgtcttttgtcccgggcttgtgtctgtacacttttccatgtggccggtgtattttgtctctggtcatttgtgcgatcctgggtgtttgagcttctccgtgctttacgtcgtgggcctggttgtgtttgtgtgcccgcgcagttattgtgccctttgtgtcaggcatatattgggccatgtggtctacgactgctccgtgtgtgataagtcagaacttcgtgcatgccggggtgctcctcgtgtgctgagtgccttctccgtgtgcgccgcttgagttggccgtgggtccaagcgttgtactctgggcaccctttgggtctgcctactgttggagttgacacaccaccaaatgaagtcagtacaccggagagctgagtccatgaggtttctctagaaccagctaggggaggcccaagggtctgggaatctggagacctggattctagatcctgcggttttgagtgaccttgggatggacggcttcttctaagaatccggtttctcctctgtgaagtagatttggtaaccctggctcctgctgacctcacggagctgttgggggaaccaaaccttggtgtaatgtactgtacacaggctccctccttgctgtccgcatccctggaaaagaattggcgtctcttcttcagaaagaaaggctctgctgttcgtatgcatttgtctgtttacttagcacaaatcatggatgcactcaagtgtgttcagtgggagagacttggaggaaaacagtcacttgcccattacagcaagcgagacgagaccaatacaatacagggtacagggcagtcaagccacaggaagcagatggcttgtgatgaaaaaggtgggcttgggaatcagctagatctgatatcaacttctgattccaacagttgagtctccataggcagtccttaacttgcctgaagtcacagtttgctcatctgtgaaataagaagtaataggtagatctacttcgtggggtttatctgaggattaaattagattatgcatgaaatgcttaaaatgttagcagatatcattcatattgttagttattataatagaggaaacagagatacttgaggaggtcaccagaggaaagctgggtggcatgggggcaggctctgtggagtaggtggcatatgagctgggccttgaaggctgggtaaataaatgtgataaagtgtcatcctatattggtgtatgtgaaagaatcatattcgtcaaatgcttttctttctccccaggcaatgagaagcacgaccttcatgttacctcccagcagggcagcagtgaaccagttgtccaagacctggcccaggttgttgaagaggtcataggggttccacagtcttttcagaaactcatatttaagggtaagcatttctttttctttctttctttttctttttttttttttgagacgaagtttcactcttgtcgcccaggctggagtgcaatggcacgatctaggctcactgcaacctccgcctcccggattcaagtgattctcctgcctcagcctctcaagtagctgggattacaggtgcataccaccatgcccggctaatttttgtatttttagtagagacagggtttcaccatgttggccaggctggtctcgaactcctgatctcaggtgatccacccgcctcggcctcccaaagtgctgggattacaggtgtgagccactgcacctggccaagggtaagcatttcttttccggcttttccttatggccaaaggacagttttaaaactgctgaacttttcctaatagtcactctgttttcaaactgggacaatttttatttatttgtttattcattcagttcttcaacagatatttattgaggacctgctaggtattggacactctcaaacacctggacaggtgtcagatttgaagtcttatgatgatggcagaaatctcaccattttcgatgaagctcatgggcagtcttccctcgctaggttagatcatcttcccattatatgttaccatggtactccctgctatttttgcatcacttctatgaaattactattaaataatcattttcttagttgcttaacatctgatttctctgttaaaataacagcctccgtgagggtggagatactgctgtgtttccagtgcctcccattgttctgactcaaaggaggttttgagcaaacttacctgaggcctggatgtggcgggctcagtggatgcatgatgctcatttctgccaggacccacaccctcctggcccctgccctctgtcttcccacccccctgagaatctatcattctggtatccactggggaaagacttaccccattgggtgtcagtcattataaagaatttagtaataggaggcatttttatttatatttcatagtgtaacatattgtctttaatttttaaaaatattttatttctgaattataaagacaatagaaattcatgtttcaaaatagaggaatgcatgaaaaagaaaatgttcccctggataaaacccctcataataacactgtgtcatcagcattcattgtggtattggggtttcctgcaaaaaatgagctttaatggctactgtagaccttaatgcctactgaagactttaaagtcttctgtagtgtggttcgttggtccctgattcctgaatatttggctctttccagtttctcactattatgaaaaggttgcactgaatattatcgtatagtagttactgtggagtcgcatgtccaattatttgtttaggataaatatctggaaatgaaattactgggtcatgacaccctctaaaaagataccagttctcattagtgaacacacttgtctatttcctgtatcctgctgaaatttattttcagtgttgtacaattattacaacttggcctacctttctcctctttttaggaaaatctctgaaggaaatggaaacaccgttgtcagcacttggaatacaagatggttgccgggtcatgttaattgggaaaaaggtaaattgctttttccatcagaaatcctcagaatcaaatgactgaagtcttttatacatgtttctgtttagaagaccaaactggggacccagattctgcattgataaaacacctctctaaacaaatacaatctttattggttttacaggattaccagttttgttgttctcataccctcctgctcctgttggttagaacttttgctctaggaattaggagcggttgtgctgccttaataatatgttttttgttttggtggtggaatcttggtctggttaaaatggtgcctgggacaggtctcattcacttggagtagaatttgcaagagtcttttgttaaaataaacttgtagatattaagaataatcactctgttccagttcaggagcctctctccctttaaccaaccttttaactaaaatctcccacaagggaaaaccttcgactggaaaggaaggttcagactaaagaactgaggggaaaaaaagacagatgaggtcagcaacccttaaggtgatgagagagggctgtggccagccctgcattgtgacacagcagaattatgagcatatgaagttcccttattgtgagttaggtggctgagtagagagagggcagataaacaaagtgaaggcaaaaaaaatctaatccagacttggaactgccaggagactggaactcaggacttgccacaaagagaagtgaataatttgggatagcataactaagcagaaagctgctagacctatctatcaattgtttacctgagagaagagggaaatattctaaatttcttgcttcagggtcagggagaatggtgatgggcaacaggcagaaccaaagagtcaagtttgaagaaactataggacttttacttggagctgacacagagcgtatggagcgaagtgtgaactcaaggaaggcaccatggcacatgcctattgtcccagcaagttgggagtctgagacaggaggatcacttgagtccaggggtttgaggctgcagtgagttatgatcatgcctgtaaacagccactgcactccaacctgggaaccgtagtgagaccctatctcaaaaaagaaaaaagtctgaacttaagtctaatctacctcttttggactgtgtgatctcatgttactttactacattaagcctcagtttcatcatctgtaaaacagcagtacttccctgatggagttgtggtaaggcttaaaaaataggtaaggtgcttaggatagtgtgtggcatgtaggaagtgttcaataaaagtattcatcgttgttaaccagcatcacattaaacaggagcgctcaattggaggctgccatttaggaattccatttaaaggaatggtagaattccacctttcttgccattctggactcctcacaagtgtttactgaaatgtgattaccctccaggcttcagtcttggttgttgatcagtatagggctgagactgaatctggcacttggattgtctccattctctgcacccaagctgtcagggccctcaccagaatgtttacctaacaccttctctctagtctggagtctttgtagatggaaaacttgatgtataaccctttgacttgatttccaagaagcaacagagttaaaactgttatttctaggtgagtggcttcatgcaggtgtggtcaggtatttttcctgacagaggctgctgttcttgttgattgctttttcttttttcttttttttttttgagacagtctcgctctgtcaccctggctggagtacaggtgcacgatctcagctcactacaaacctccacctcccaggttcaagctatactcctgcctcagcctcccgagtagctaggactacaggtgcacgccagcatgcctggctaatttttttgtttttttagtagagacagtgtttcaccatgttggccaggctggtcttgaactcctgacctcaaatgatctgcccatctcggcctcccaaagtgctgggattacaggcatgagccaccatgcccagcctgttctttttgactattggctttattttcttcttaaacattttagaacagtccacaggaagaggttgaactaaagaagttgaaacatttggagaagtctgtggagaagatagctgaccagctggaagagttgaataaagagcttactggaatccagcaggtaactctcttcatggaccttaactttctgccttctatcagagcttcctggatataacttgtggttatggggacatgttctgcagtcagactccctgggttcagatcctggattcaccctttctcttactgtgaacaagtttatctttgtctcaagttcctcatctgtaaaaatggaataatggtgacatttccctattaggattgttgggagaattaaataatgtagattgagcttgacacatactaagtgctttataagcatttattgtcatagttattgtcaaaccccagccagcatccatttatgctcacaggagagcacctgccttgctaggatcatgtattgtctgaaatagaacaagtagcttctctctgggctgttgtaatgtgtttggcaaggcaaataacattttgttggttcatagaaggtccaagttgaacatgatagtggggttgggggagtcatcctattcaattccttatattagagatggggtactaaaacccagtaaggattaggactagctcaagaccacttttatttatttttccctctcattttatagcattaattggggtgtgtttgtgttttggcttttttttttttttttttttttttgatatggagtctcgctctgtcacccaggctggagtgcagtggtgcaatctcagtggctccctgtagcctctgcctgccaggttcaagtgattctcctgcctcagcctcccgagtagctgggattacaggtgccgcctgccaccacatctgtctgatttttttgtatttttaatagagatggggtttcaccatgttggccagactggtctcaaactcctgacctcaagtgatctgcccgcctcggcctcccaaagtgctgggattacaggcatgagccactgcgcccggcctatatgtttgtgttttaattacagaatacatgctgactgtacaaaagttttaagtacatgtataggcactaatatggaaaataaaaattacccatggggcaccaactcagagatgacgattaccaaagcctgaaatatatttttcatcttaaaaaaatttgatataatgttatttacactttataaactattcttttattggataaaaaattaaacattttcctgtgatggtatttttcaaagctcgcatgcatttcatcttgtataaatgtattatttacctagccaactctgtattgttcatttaatattatttttaccattatgtgtaatgcttctttgactgtccttggacgtaaatcttttttgaccattcctggtttttttggtagaataaattctttgagttggaattgctgggtgatgtttaaagctcttgctacgtgttgtgaaatctgtgtctgtagctcgtggctgtgataaacatcctcagagatccctgctatccaactcttgtcaccagctaactggtcattaggccaagctgtgtgagtgaaccattagacaatttgataaaaataagcactgctgccattctttagcatgcgtctgtgccacaagttagtgacacatgtacatatattccctttacctcacagtaaccatctagggtgtgggcatcataatcttcatttttaaaatgagggtactgaggcatgaataggctaaataatttgctcaagatcacaagttagtaaatggcagtcagttttcaggcgtaggctttgaagactctaaacctgtgcttttaacatctgcctcttcttgtgactgggggcttcactggagccaagcctcaggaggcatttgcagccacagtgggtcatgcgaggtagagcagactgcaacctgatagaattcttggactggcccacggccagcctttttaatttttccaagagttaaagttgtggatctgagatgtggcctggcctgccagggctatggtgggctcagtgtgattgcatcattagtattgtggcatggagtcttccgtcagcctcagagaacccttgcaataatgcattatttccccgcagggttttctgcccaaggatttgcaagctgaagctctctgcaaacttgataggagagtaaaagccacaatagagcagtttatgaagatcttggaggagattgacacactggtaagtaaatattcagctgagaagaactagttttctttgactttatttcagtcacattcactctttcagtaatttactctcctattgcctgagcaaacccatcacttgagaatattaagcatctactattgtgtgccagtcatgttgctaggtcctgggtgaatgcatgatgataagacagttcctgctttctaggcactcacagccctccagcataggacttttatcatttacacttatgtttgccagtagcatctgtaatcgtcatgaagctgggacccaaggagtccacgatctcatggtccaggaaacagaggatttaactttctctgatgaatatgtgactgataattctgcagggctcattacttatagatgattcagccagacccaggtcatgtgaggccattgaaaatcattaactcttttgcagatgatagtaatgatatctctagcctgatgcttcattcttgaaggtgaactgcactgtgtacttctgttggccagggtgggtgtaaagaagcagcagcaggcacttttcctgtcacaatgagcccatggtgtggccagggcagagtatccatacataggaaacaataaaagaacaaagtctgtgttaaagatcagttcctatggcccagacattgagaacacagggagcttttatagggacaagagccatggaaaggccatacaggatacagacccagggaaagggttcctgaaaatggatatcacatttacattggtgacctgtgacctgttttgtgtactgtgggtgtttcttatgtgctctcatgtcattttcactgaggattatttgttacatgtttactatttactaacttgtattatcaacttactcttccatagatcctgccagaaaatttcaaagacagtagattgaaaaggaaaggcttggtaaaaaaggttcaggtgagttgtgtaatagtgcacgacaaggtgtaatatgttaatgtgtaggtatgtgtgtttatctgttcaaaatcaggtagtgtaggagcgtggtgtgtggtatgggcttgttttggttatatttatcagcaggaaccccaaacgtcagagaagagccacctgtgtccctgtaattatatttgaatttaaactatttagggagggaactcactggagagcaggtagggctgacacattacacaattccaggaggcagtattcatgcacacagtgcttcctgcgattgtgcagttgctgtgcagtggccctgaggcaaagctccctgcctttaccaccttttaggggattgctggcctagagcatggtcagaatgctggtcctatgctccctccctccccttaccttggaacccaggccagtggcccatctccattcatgcacaatctgttttgagtctcagccatgggttccccagaatgggtaagcaaggagccttgtgtgggcagtggtcggctacccctggatgggcccttactgccccgtgtgtattttctaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggttagaacccagtgttgactgagtctgtgcttgaaaccaggccagagccatggattaggaagggcaaagagaaggcaccagaatgagtaaagcaggcaggtggtgaagccaaccataaacttctcaggagtgacatgtgcttccttcaaaggcatttttgttaaccatatccttctgagttctatgtttccttcacagctgttctatccattttgtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgcttt

SEQ ID NO: 37516 - DNA, 162934 bp, Homo sapiens; identical to SEQ ID NO: 36246

SEQ ID NO: 37517 - DNA, 55896 bp, Homo sapiens; identical to SEQ ID NO: 37466

SEQ ID NO: 37518 - DNA, 71555 bp, Homo sapiens
tccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggtgagcgaggcccggcatggagacgccggtcccggcctgccccgcccccgcctctgcctggtgccggctctgaaggtgcctcccggggcccctctaattcgcgggaccctgcggggtccacccgggagaccccacagccctcagtaacgtgggagtgggggttactctctgagctcaactgctcgggagtagctgccttttttcctctcttgggtactcttgattttggatttgatattccggtgataaacaggagaatgaactggtgagatagtgtggtccaccagttctcgtatctgtaagtagtagtttcagcgaagatcgtagccgttctggagtttcagtccgctggacgtaatgttcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgggcccggccggacgtaatgttcttaatggccaaagattgtattatattcgacttctacttcagtacctggcatgtaggggatgctcaataaatgcttgttaaattagtagatcatcaagtctaataaagtgtttcccttagcaccgaatggttctcaatttctccgataccgcacagcaatactcgtaatgtttaaatgctcggctttcagttgggctaatgtaggtgaatttcaccataagtaacatagactggtctacgatcaaaagatgtttcaagtagcatattctgaagagataacgaatgatttcggtgacaatcagaatataatattagactagaaatcgctatcagaaaacccatatcctttctttattctgcagtaatttattttagaacaagatatttcaaagtgactttaaagcgtcgtttttcaaattaacaggtaaattgggttctaatgactataaaatttagaaaagtaaaaactgcatatatattttttaaagacactttagaacttgttaaaaactttggttgaaaatactatctcttaccatttatttgccattttttaaatttattaagcactttgcgttatatagtccatgaaaaacctagtgaaatattatagattgtcaacgagttatgtctactttaaaattctaaaattatttttaagtgtcagcaagttcaaagtagtgagataacgttcaacaaataaattttttttcctgtgcatgttttggaagagtaatggattactgaattatatatgttttatcacataaagtaactttagagattattgagaatatcctcattttacaagataatatggtggaaagagcaaggtctttggagttagaggaaagttcagtgtatcagatatgccatttattagctgtgtgatttggggcaagtttcctaacccctttgaattttagtttactctaagaaagggctaataaattctgtttcattttatctgcataacagatcttagtagacattatatgcaaaacacctaccacagggcctgacacatattaggaaacctagttccagagaggaaatgtgacctgctttaaggtcatatggctaaaagaagacctgtattttgaaaagagggggaaatgtttttagtttctttttttttacattgaggctatgataaattccttttccagaagtggatagttgatgcagctttcatggctaatattcttttttaagaataaaaattcagtgagtcagtatacaagaattgcagtttttaaataagcgtttacgtctgctctgtggtgaattgctatgcttgtagactacaaattgttatataataataacttgtgctttatggtctactaaatgctttcacaaacttacttcatttggttcttacaaccttagtttttgaatgctactttctaaagctttttacattcttgattcagggaaaaacaaattactaaggaggtagttatcattttgatgttcttcccctaaagctatttcgcttctggttaggtttctgtgtttccaagacccttctctcagtttagataatgtttcaatctttgtgtgtatgtgggtgtgtgtgtgtttaggaaatttctgggagtaggtttttgtttttagatgaaaatttgtttctaatatcaggcagtcatttgggttttttgtttgttttattccctttcatgtttaatacttagttcatttttgcattaaagattgaatttggacctttctgatattgaaagcattacataatttccatcatcttcttcatttgcatacattaaaccagtgttacacaatccagggtgaaccatgaacacttattagctatttgtcaacttagattacacttccagttcaattgtaagataaacagaggaagatgaccagaaacaaaaactattttatgttgcttccaatattttatattgtatgagaatattaccttctaaattaagaaaatcatgtatttctcaatgtaattgaattgtattatatcaatataattagaaactgtaaaaaaaataataattcaactacaggccaaatatgcagccatttagtagatacatatttctaagacattagctgatcttgcatttctaatattgtaactcagtagtattagtttggcacatcttagattcaattcaattcagtcaaattaggtaaggtctcagcctcagaaatctgcctaggtactttttaaacatcatttagtgtttaccatctagaactggctgtagagaatgttggaataaaagaggggatgggttgcaagaagtgttacacagggtagtatagtggaaagtgttctggactgaaaaagaaaatttagatgctgtactgattctgccataatatatttttgtaactttgaggaagtcaccacatttttctgggcctgtggttactcatgtaaactgactgaacaagatcatttaaggtcttttccagttctaaaatgaaaacacattcatgttttccagtatttaactgttttctatagtaagcttagcagttctttaaagactgatcatggtctcctatagaattcagttggtgaccaactaatcctgggttgacagggcaaatgatatcccattgtacagatattgacaagcagtcatagagtttgacttgccagaagccgcatgcctaagtaaatggtaaagctgggaattgaatatgagacttctcacttgtgagtcagttgccctttccactggatttacagtgtcactcagtactttctgaagtactctataaccaaacctaatatgggaaaggggaaacaaaatactgatttcctttttagtgtagttggtcctgagcatttaatgaacattctcatctgtgcgtaatactctgaggtactataaaagataaatagggcttggtgcggtggctcacacctgtaatccgagcactttggagggccagtgcgggcagatcacttgaagccaggagttcaagaccaccctggccaacacggagaaaccccgtcactactgaaagtacaaaaattagctgggtgtggtggcacaggcctgtaatcccagctacttgagtggctgaggcatgagaatcgtttgaacccaggaggcagaggttgcagtgagctgagatcatgccaccgcaccctagcctggacaacagagggagactctgtctcaaaaaaaaaaaaaaaaaaaagatgatagaagaatcctaggattacctccttaaaatgtctgacttagtatgatatcagactggagtaaacacagaacagttaactatagaccacaaatttaaaactgaatatagtgtaaattaaacacttaagccataatttgaaaatagagttaatcacagaaggttccattgagtagggacaagtttaaaactaggttttgaataaagtgaccatcgtgggttgggaaagtcactaagatgaattttctttgtagttgttcctctgcctaaagcgctgttcccccataacttaagatgactgactcctcaccagtcaagtcccacctcaaatgttattaacacttccttagagaagcattccctgaacaacctagatcttttgtcatttctattatctttcatggtacttaccagtaactgaaattgtgtctctccttcagcaaaatgtaaggcgctttattcacttttgtaaccccaatgcctagaacctagaaggttctctatacatatttgttcaatgagtacatgaaagtatcacagcataatcataagaattaaatgcccatcttgttctcttatattacatgtgataaaataggagctgagttatgcgatttggctaaggcaacacgttagaaatgagatccgagtcttgttttaatgtcgactctattatagttagcagatacttttgtttagcagggataaaaaatgctgtaaagggccagatgctatgagtaagccacgtatggtaggtctttactacagagtgctaaaaagacactatttacaatggttgcttttgaaaagggagacccataatgctgacctcaactatagtgtaggaacaaagctatagtattggacacataaaattactgcagcatttgtatatattcttcagctttgttaaggagacacacaaaagttttgttttaaaagctaaaatatgctacaaagaggagatatagatagaacttaaacagttatatgtactttgtaggtttaagttataaatatatggggaattggtattagagaaaaacctaatttatagtggtctaaacaaactgagtacatagatttgttagtcactatttaattatggatacctaaaataatcaatacattctttcatgtgaaagtgaccactgatttcagtagaaatctggaattactatagttaagaggtagctacagagataatttttgcattgtacacgtgtagcttaaaagatagcatgagcatattatttgaaataaaagcctagaaaatgggtgagatgtactgtggcaggtattaaaagactgcatgaaacattcagaagaaagtttgaataatcaaagctttacttttatgttatcaaatccatcttgtcagcagatggcagttccactctgccacagtttattaatagatattgaagttctaacatagttggaggctccaagtcctaactaataaatgtatgatctatgcttgttctgtcttgttccgcatttccagccagaacaatgccagcatcaccaggggtccattcagatagttcatagaacagggccaaatgaaactgacagctgtagtcactgaactaaaaataacatgaattcagaacaattaaaagaattatttaataataaattaagagcacaaaggcatacatccttttccatttaggttaggtgtgtgtttggttgttttctttaacatgacttgtctgaaggaatggagtcatcttacatcataaagaaattaatttttaaaggaatttctttaaaaataacacacaaacacacaaaacctgatttttgtttttgtgcctttcaatagtagttgcatggaaatgttctatataccatctcatattcttctgtattttttattaagaaattaaatttaaatctacttaattgtatgagactaaagttgtagacccaaaacaaagaggtttcaaccatagggggagaaatgcttatcataaagtaattaatcaaaaacattttgatttagaaaacattcataaatttagaaggaaatatttccaaattgacctcccttttaaaaccaaagtcctttttgcattcctctgttttttacaaatgaaggattatgaagaatatctgaaatatttatttgtatgtcaccattttagttggatgtgtgtgatggggaaatacttgtaacttgatatgttctcttttttactcttgatgaaaattcatctttggggaaaaaacagtcatttaaaataatgttgggctaggtacggtggctcacacctgtaatcccaacactttgggaggccaaggtgggagattgtatgaggccaggagtttgagacgagtctgggcaacatagtgagaccctgtctctataaaaaattttaaaaaacaaaaaacctaattgttaattacagtgtgtcaaataaactgtattattcagaaaagaatacggttcagaaagcacgtttgatttgtgaacttggactagaaatttggtagtaaataaaaagtggccttctttcagtggtttacaacttgaatattaagttttttcattgtttacctcagttgccagtatgtctcaagagtggccatctatgccactttttttctgttgatctaccatatgtcaagaaaaatatcaaatttgctttctgtagtttgtaacattggctcattccttatctaataatgtacataatctccttatgtgtttttaggcttggcctttgcagtccagacatactattattctacatctgatcttctccacgattttatgttcttgattaatacaataaggaaatttgttaccaagatatttgcatttgaaacattttcttagaaatatgtgatatattttttaaaaatctatacacatgtaagattttccccagtcagtggagtgctgttttacatagcctgagaggtggagtgcagacagtaatgaactttcttaaccagcgtttcctgttggagcggtggtgtccacaattttttgtttgtctgtctcccactggtaaaacaaaacactttctattttgtatactcagttttcagtgtgtatgtatgaagtcggtatttttaaacaatgggagatgaaaggtttcatactatcatttgatcatggctcaagttgcaataagtactttctaaataaaacctttctaaaatgtgagaattgacttaattaaaatgagataatatctgtaaatctacttaactaaggtcaagtaaactacaatatacacaagtgagggactgataatggagtcagtatttgacatattgaacttaataagcctgtaggaccccttagtctcaaaggcagttttaaatatatcttgagcttgggcaaaaaacctggatgggagagatttgagagtatgaatccatgagattagagaacagattcagaaacaaaagggccaaggacagaaccctggaaagtagcaacatctaaggtttggacagaggaaggaagaatcagtgaaggaggctaaaatagaactcttaagcagagacaggcagagaagggattgttgacagccatctttggagactgccataagccctttatacacaagccttctattaacccaacttcactcttttcttaaaggagattagggctttttaaaacccccttctaaacagctaaaatctgattcgaatataatcttttgaaaagttaattgttgttagttatcatacttgctgcctttgagtagcatttttctctgtaccaggcactggaccaaatcctggcaggcctctgttttgttggcaccatgaaacatacctgaaagctgactctgatttactaattacatgatccttgaataggtaacttcagttcttggagccttggttttcttctctctaaggtaggaataaaaaatcctatatattcatgggtttatggtgacactcaaactccatcatatttgtaagaaagagctttacaagttgtaatatattgttaaatataaggttgcattatcgttatacagataataaaattgcatttctttaaaatgttatttcttgaagaaaggaatgagaagtatattggaatgccctgggaagctttttttatgctacgtagcaccttctgccacctctaattcccattcagacttctcccttagagagctaatatcagaatggggggaaggagagcaaaatataccaggaaacaactttatccattgtatatatcatctgattattctatcttctactcttatggatatatgcttatactcttttttgtttaaagcacaaaactcctgtctctggccaggtgcagtggttcacgcctgtaatcccagcactttggaaggccaacccaggcagatcgcctgagctcaggagttcaagaccagcctggacaagatggcaaaaccccgactctactaaaaatacaaaaattagctgggtgtggtggcacaagcctgtaatcccagctactttggggtggctgaggcaggagaatcacttcagccagagaggcagaggctgcagtgagctgagatcgcgccactgcactccagcatgggcaacagagtgagaccctgtctcaaaaaaacaaacaaaacaaaacaaaacaaactcctgtcctcctgccggtatttcttacttgtttttaaaagttaagaaatgtaactatttttctataaactactgtttaattatgagtcattcctcttttcaactcagtagagaaaagcatttaatcttgccacaacaaggataatttccatgtaatacttacctcttttatgtatctttgtactcagaaatttcaagattaattcggttatttcaaaattcagtcttcccccataaggattttccttttccctttctcctgcccaagatgacatatgggtgctgtggaaagcttccacaaataatataaacagcaagggagagctctctggtctgtgtgatggcttccactgaaatatcttgccttattatctgttgttaatggattagccttgaatgcagtgattttcaaacattgaaactacctggagggcttggtaaaacatggattgcttggccttaccgtcagactctataattctgggttgcaccctgagaatttatatttctaataaatatccaggtgatgttgatactgctgaaccggagaccacacttttagagccactggcatatgctttcactgtccttatatctgctttccttctggaacgtctttttcttttggcttctctgactctctcctagtttgcctgctaccatattgactgttccttcctgttccttgcccattccttctcctctcttgtgatctaaatgttgaactgcttcaaagctcagttcctctactccactatctccatattatttttggttacctcttccaactgattgactagaaaaactgactacatgctaatgactcccaagtttgtatctctttgtctgacttctccatagatcctctcactcacgtttctaccttcttacttgatatctcctcttggatatccagtaggcatcttaaacttcatatgactaaaaccaaactctgagttattaaaaaaaaatctgcatcattcttatccctcagtaaactgttgtccagtctaggtgttttccttgattcagctcttttcctctacacctgtcctgcctggatgcagagcatcagcaaaccctattgactctacttctaaaacatttcccagatctgcccagtttctgcactaccattgaccttgccctcgtagctattgttgcttgtttggactgctgtaatggcttcctaatgggtctctatttacatatcctagcttccctacaatcctttctttaagagctataatgattttgtttaatgtcacataccatccttacttccttgaattttttcagttccttcacattgcacttagactgaaattcaaactcctttttatggtaggtagagccgttcaggatccaacctctgcctgtccctccagccttaccttacaatcactcttcccttcctccactatacaccagccacaccaaacactcccaagtatttctctaaatcatcactaaaatgtcacctttctcagtgaggccttgagtgattaccttgtctaaaattggagtgaggcagagtgcatacatgtgtgtatacacacacaattatactccttttcttcttagcacacaactcccttcctttttatttgtctttttccacaagaatataaacaatgagaacaaggattttgatttggtttgttcactcttgtatcatcagtgcctaaaatagcgcatagcccttagattgggctcacatattggagtaaataaggtagtgaggtttttcttttcccttagggcaaagctttatattagttgtttcttctgtgtgtgtgtgtgtgtgtgtgtgtgtgtgtgtgtgtgtgtgtgtgtgtgtgacagagtctagctctgttgcccaggctggagttcagtggcgcgatctcggctcactgcaacctcggcctctcaggttcacgccattctcctgcctcagcctccccagtagctgggattacaggtgcctgccaccacgccccgttaattttttgtatttttagtagagatggggtttcaccgtgttagccaggatggtctcaatctcctgacctcgtgatccgcctgcctcagcctcccaaagtgctgggattggtgccttgtgtcatccaaatgtcagattcgtaacctctttatatggccttttcaaactgcccagcctggagctgccactagtctcttggtcatagcatcctattttttgttgttgtcgttgttctatgtggcatttttttaaagtctgatttttttcttactcatcttttgtttgtatatcgattttcttttctcctcccctcccttcacatacgctagaaagtacatttgtgtagatcagagcctttgtcttatttctttctgtatttctgatgtcccaaacagtagctggatgtagtacacactaaagaaatattggtttaaggagtaaacaaacgaagttcattattctttcaacatcaagcctcacttgcatcctttgaaggcagaagacctaacccagttctccctgcttgctgaccaggccttccccttggctttcattaatcctctgaaacccagctgtgttcttcattaagtatttgagctagctaccatcccacagacctctaatgtaggtcccaacactctgccctaccgcagcctccttcctgcaatcagaagactccttacttctcagttagcttgctttttgcttcacaagagcttttctttatcccttacgtgttctactggggctgagggaacccgggttagggcctcccttggtctgtcttccttgccacaatccttactcctttgaagcttctggtgtttgcagagcacatgctgtgaggatgcctgctcttagggatctaagtgagaagagaagggtatgagtcttttttgctgttgaatccctaccctaaccctatcctgaaaagggggagggaggagtttattagccttcatcattagcccttacctttggctctcttcagctggtaagtgtttaaaagtttttaagtactattatttagtcttaaatttcttctctaccgcactttcattccatgaaggcaggggtccattctttatatatattttttcttctcatccccagtgtatctacctttatgctatttttaaaaatgggaagtcatttttgatacacacaaacttaattctttaagtattgactgtgcttataatctcactcctttgaattcacagcagttattatttctatcctgtatttcaggtcagtacaaccttggacatcttcacctttctttattataactttagatcctgtcatttcactgtgcatgtgaaatatctcgtggccctaataagaatggaggcttcttaagcccatgggctcatcttacaggaatgtgcctgttttgtatttcagggtgttctagaaaattgctttcttgagcaaaaaggagaaagtttttcatgtcctcatttgaccacattttgttcccatggctttaagttgaaagctcagaatcagctctactctcatcactaggtggcacttgtgaattacaaatagtcaaatgaatttttatgacaaacatgtgattcacaaatatagataatgtttggaatccctgcatggacgttcctcaaaatggaagaaatgaaagaaggggattcctagtaagtaccagttgctgtgatgtatttataaatacatggttgaagaataaattacttcataatcatttcgtatttaatagtaatatcaataggtaaagtctggtctccatgcctgtgttcttaaactaatgttgccacaaagttgaaatttttttaggacctgcttgctattcatcttagttaattgcaagagaagtgagtactacaggtcaggtgcagtggctcacacctgtaatcccagcactttgggaggctgaggcagggcgattacttgagttcagggattcaggaccaacctgggcaacatagtgggatcccatctctacccaaaagaaaaaagaaagaaaagaaatgagtactacagccctttacactgattcatacccaattccaagcacttactgttctttgtagtatttgaggaaatacctggttttaacttacgaatcctgtagatattcatgaaggaaaatgtcagcacttctattttactgctgagaaaacagaaactcaaacttgtccaccattaagagataataggtagacagagccctacattcaaactcaagtctgttggatttcagagcctgggtgtgctctttcatttattctaatggtaccaggtagccagtaccctctattcacaataaagtaactgaatggcaagtacaaatgtctgatgagaattgtgaaggagaacaagaacctaaaccacagaacactgagtgcccagggctaggacgagtgaaatgggaagtcaacaaaacaaagactagctaccagagaagttggcctactttgaaattttgcctagaggcagccccatttcctttaagccactgatgaacagaagctgaatatagagtatgttcatcattaggtgctctaggcttcaaattctggcttctctgaatattttctgaccatccaatcttgggcaagttacaaccatgtgactccatttgcctcccttttaaatggaagaggattaaatgtgttaatgtatgagaagcacatagaatagtacctggcacatagtaaacattcaataaatgttaaccatttgagtagctttagacattgaacaacatggtaaatgttcattctgccttattgatacatgaagtggaatttaagctatggctagagtggtcatacacatcgcagtttacaactagtgtcctaatattattattattaatgccctttttttgatctccaaagtgccctcagttagataataactcatttgatcaacctagttatagtcaactttgttatagaagagttttgtgccaggaatttgttcatgtaagtctaaagtaaaagttcctccaagggaagatactaacttctacttcccgacatggggctttatatatgttacaaattaggactggtaacattcccgtgttagactacctggcatcagactgcactttaacacttgctagctatatagccttgggcaagttttacttctttaaagctaggcacttcaactgtaaaatgaggacagcattagtaccttcctctaggcctgtgtaaatgaggtaatgtatataaagcattagttaagtgcctgctgcatagaaagtacatataaatatggttaagagatgcagattttttgctaaagaaaaaggccttgatacaaagtgcttaggttcattggaagctgagagattggagtaggtggtgcttaactaaggtcctttcacaatgataaaatctaatgattttattctaacaagtatcaaaagctatttttgttttctttttttatattatgaaaaatgtcaaatatttgtaaaaataggactccatgagagagcaatgaacccatgcagtattcatcagttggcttcaacaatagtatgatacatgtctgatctttatttttatgacttttgaaaaataactgtaatgagatctattttacacatcataaaattcacccatttgaagtgtacaatttggtgggttttgcaaatttaccaggttgtcagccaccaccataaattaggtttttggttttttttttttaataatttcatcactttgtcaggataccagctactcatttactgttaattctaattttcaccctcggacccaggtatctatctatagatttgccttttctgaacattttgtataaatggaatcatacaatatgtggtctctggtgtctgacttctttgacttagcataatgtttttggagttcatatcgtaagtaacatatatcaatagtttttcttgcggaataaaattccatggaataaataatactatattttgtctgtccttcatagccggtcttttaacatctatatttatatcgtttctcctccattccctatccctgttgaattattcaaaggctatttttaatttcttaaatatgatagctgaaaatatttattatatgttcctgctttttgtttttccatatcatcttctgtcttctcattcatcttgtctgttttagtttttttttctccatttaacaaatcactttactttgttcctccatgtgtcttttttggttttacttgagaatgaaagggtgtacagatcataaactttcaaagatagagacaagcatgcatttaattatcttctcactttaacaaaaattcatacttgttcagtggcaaatccagatactgttgatttccatgttttttttttttttaatttaaagtcttaaagattgactttagttttttatattgggctgatctatttgattccgattcttgtggtgttttttgtttgttttttgtttgtttgtttaactcaggttgttggaagaggagcctttggagttgtttgcaaagctaagtggagagcaaaagatgttgctattaaacaaatagaaagtgaatctgagaggaaagcgtttattgtagaggtaagttgagatttcatttcttttgtgtagttctgcacttaagatactctgtgaatttaatattatgaaaaagattggtttctcagatgtcatttctttgtatacatgaacatcagcaattcggtttaatcaaaggtactgccataggaacattttctcgttcatactcttaattctgattaaaaattaggggaaaagcgacttaactacataaatgaattcacccctgaattaaaacagtttcatccatggaattcagatctatttcaaggcgtaatattttaattttaaaatagaaaagaaatggtatgctttcccattatctaaaattaagaaattttatacacttactttaaatggaatgtttttagaaactcagattattttaaagaaaaattatttcaaatttgatttttctcatttagcatgaaaatttgcacctattcttttagaaatagattagattgaatgatgaaagaaaatccaataatcatgaaattagcatattatcaaatttatcctttactaactttgttattttgtattttggatcacattatttagttaaatcaatgtttttatcactattaaacctcattggccaatggataagtggcctgtaccttataagccttctgaatttatatctctgttttttcatttaatcataatttcaaaatatacttcatatttttaatgtataacatggaaaaatgaggacttaattgtgatatgagaaagtgatttgtaagtggctgaatgagttgagaaatgctgataagtgatttgatgtcagcatgaagaaagatgatttctagtaatatgttctaggagtctagcctcagctttgttttatgcaatatttttattacagtttagataaagctattgatcatttcctgttacattagcagtttcacaaagctgggtgaaatagcatatgtgttaaacattaggaatcacaagtcaaaaagatcgtaatagcgtgaagaaaattttttaaatccagatgagatgtgcatgtaatgtaaaaaatcaaatggttctccaaaaattcttagtaaaaaagacttcagtctcctgtacctcctccaatctaattttctgcttcccaaagacaactactttgagctcattccttcatgtttggtgtccccagtccagatgctgtttattaccccttctctaaagaatcaacctctagtcttctgctgggatgataagagatagtcattgagctgtttgaagtcaaggaaggaatctttgagtcttttacactgtcccctgccctatcctttgattagctcatttgcataggtacctcattctgctgccactccccaaccttttggaagctttgtgagataaatctggttgtttctccatttttctcattgccagtttatgatgcagctcttctaggtctgctctatcagttattgctagtcatttgctttccagcttccaaaaatgtatgctgtttgtgcactttgcattctcttcatccttctgaggttatgccttaaaatttttcaaatctttaccatcttagtgggaattagggagagaggaggaaaaaatgcttgtataatctgctatctgaatctcagtgctgaaccttagcaagatgaaatatagtaaatatattttcatatagtaaataaatataataaatagtgatactaattctattggacgaaaaatccacacatgttggctctagatagatagagctttttattagcatacagtatgaaggtttagagacattagtgtactgaatatgagccagcagcataatgtatgtaatagagaagaggaagaagagtggaaaaagggcagaaaagagaggagaagggagaaaagaatgagcaagaagcagtttgctgtggagcgggatgcattaatagaaagaagtttgaagacagacatgatggttcacatctgtaatcccagaactttgggaatggcagatgggttgcttgagcccaggagtttgagatcagtctggacaacatggcaaaaccccatctctacaaaaaatacaaaaattaaccaggcatggtggctgtgcacctgtagtcccagctactccagaggctgaggtaggattgcatgagtccaggaggcagaggttgcagtgacccaagattgtaccactgcactgcagcatgggtaacagagcaaaacctgtctcaaaagaaagaaagaaagaaagaagtttgagatctagaataagagaagtgagtatagccaaacccctcattgacctctgtatggatcattggatcagggatgattaaaactgaaagagggaaaccagctagtaggctataatgatcactgcagcagttcaggttgggattactaaggcaatggcagtgggaatggagaggagagaattaattcaagaaatgagaaatggaatggaggcaagtatacagagggagtgcacattttaagtcagatagactaaagttcacaccccacttcttagctatagaacaggtcattcaaccctctctgagacttgaggttaaaatctcatctttaaaatggaaatgataatacctaccttgcggagttgtgataattatacaatatctataaagtgcacattagggccccacgcagagtagctagactgttcaactatagctatgaagatgataacaatgatagcatgacgtctggtttggataatgcagctcagtaccatctctgggatcatatcctaacatttcttggcagagttcatctcttcttattctatatactcatcgtgccttgttcataactcctgttatagcactttgcacattgatttaattatttgtttagatgtctatctctccagctaaactgtatgagctggagaacagggattctgtgccattctgggcagtcacttggtattttcagtgactatgattgcaatgcctgttacatagtaaatagtgattgttgaatgatttaaacaaatgttttgtacaacagtaagattttaatgatactgtgaaatcagtacttcaaaagttatcactttttaaaagaaaccttaatttcttaacagcttcggcagttatcccgtgtgaaccatcctaatattgtaaagctttatggagcctgcttgaatccagtaagtttgttactttttcatggtcacctgtgagaaatgacatggcagatgtgtgtgtgtagtttatgtagctatttttgggtttttttgttttttttaagtttttcaaaaatattatattttttcaagataaaaaggtacctccaatactttaaaatatcagcagtgatcccaatagttcaaggactatatgagtacatgtggctattatacacgcacaatatgtcaccaacacactctaaatagtgagaatacagcaccgtggcattgctcccatattattatttttttctttctctttatgtatttattgagttacttacttgtttttgatatctttttttattatactttaagttctaggttacatgtgcacaacgtgcaggtttgttacgtatgtatacatttgccatgttggtgtgctgcacccattaactcgtcatttacattaggtatttctcctaatgcttatccctcccacctctccccaccccacaacaggacccagtgtgtgatgttccccttcctgtgtccaagtgttctcattgttcagttcccatctatgagtgagaacatgtggtgtttggttttctgtccttgcaatagtttgctcagaataatggtttccagcttcatccatgtccctacaaaggacatgaactcatccttttttatggctgcatagtattccatggtgtatatgtgccacaatttcttaatccagtctatcattgatggacatttgggttggttccaagtctttgctattgtgaatagtgccacagtaaacatacgtgtccatgtgtctttatagcagcatgatttataatcctttgggtatatacccagtagtgggatggctgagtcaaatggtatttctactctagatccttgaggaattgccacactgtcttccacaatggctgaactagtttacagtcccaccaacggtgtaaaagtgttcctatttctccacatcctctccagcacctgttgtttcctgactttttaatggtcaccattctaactggtgtgagatggtatctcattgtggttttgatttacatttttctgatggccagtgatgatgagcattttttcatgtgtcttttggctgcataaacatcttcttttgagaagtgtctgttcatatcctttgcccactttttgatggggttgtttgattttttcttgtaaatttgtttaagttctttgtagattctggatattagccctttgtcagatgcgtagattgcaaaaattttctcccattctgtaggttgcgtgttcactctgatgatagtttcttttgctgtgcagaagctcgttagtttaattagatcccatttgtcaattttggcttttgttgccattgcttttggtgttttagtcctgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacataaggctagccagttttcccagcaccatttattaaatggggaatcctttccccatttcttgtttttgtcaggtttgtcaaagatcagatggttgtagatgtatggtattatttctgagggctctgttctgttccattggtctatatctctgttttggtaccagtaccgtgctgttttggttactgtagccttgtagtatagtttgaagtcaggtagcgtgatgcctccagctttgttcttttggcttaggattgtcttggcaatgtgggctcttttttggttccatatgaactttaaagtaattttttccaattctgtgaagaaagtcattggtagcttgatggggatggcattgaatctataaattaccttgggcagtatgaccattttcacgatattgattcttcctatccatgagcatggaatgttcttccatttatttgtgtcttcttttattccaatgagcagtggtttgtagttctccttgaagaggtccttcacatcccttgtaagttggattcctaggtattttattctctttgaagcaattgtgaatgggagttcactcatgatttggctctctgtttgtctgttattagtgtataggaatgcttgtgatttttgcacattaattttgtatcctgagactttgctgaagttgcttatcagcttaaggagattttgggctgagacaatggggttttctaaatatacaatgatgtcatctgcaaacggacaatttgacttcctcttttcctaattgaataccctttatttctttctcctgtctgattgccctggccagaacttccaacactatgttgaataggagtggtgagtgagggcatccttgtcttgtgccagttttcaaagagaatgcttccagtttttgtctattcaggatgatattggctgtgggtttgtcataaatagctcttattattttgagatacgtcccatcagtacctagtttattgagagtttttagcatgaagggctgttgaattttgtcaaagcccttttctgcatctattgagataattatgtggtttttgtcattggttctgtttatatgatggattatgtctattgatatgtgtatgttgaaccagccttgcaacccagggatgaggccaacttgatcgtggtggataagctttttgatgggctgctggattcggtttgccagtattttattgaggatttttgcatcgatgttcatcagggatattggtctaaaactctctttttttgttgtttttatgccaggctttggtatcagaatgatgctggcctcataaaatgagttagggaggattccctctttttctatcgattggaatagtttcagaaggaatggtaccagctcctctttgtacctctggtagaattcggctgtgaatccatctggtcctggactttttttgtttggtaggctattcattattgcctcaatttcagagcctgttattggtctattcagggattcaacttcttcctggtttagtcttgggagggtgtatgtgtccagtaatttatccatttcttctagattttgtagtttattttcatagaggtgtttatagtattctctgatggtagtttgtatttctgtaaaattggtggtgatatccccattatcattttttatcgtgtctatttgattcttctctcttttcttctttattagtcttgctagtggtctatcagttttgctgatcttttcaaaaaaccagctcctggattcattgattttttttttgaagggtttgttgtgtctctgtctccttcagttctgctccgatcttagttatttcttgccttctgccaacttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttcttctcattggtttcaaagaacatctttatttctgccttcatttcgttacgtacccagtagtccattgttcagtttccatgtagttgagtggttttgagtgagtttcttaatcctgagtctagtttgattccactgtggtcagagagacagtttgttgtaatttctgttcttttacatttgctgaggagtgttttacttgcaactatgtggtcaattttggaataagtgcaatgtggtgctgagaagaatgtgtattctgttgatttgggatggagagttctatagatgtctattaggtccacttggtgcagagctgagttcaattcgtggatatccttgttaactttctgtctcgttaatttgtctaacattgacagtggggtgttaaagcctcccaatattattgtatgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctatgtgtgtctctgcccgtgagatgagtctcctgaatacagcacacttactggtcttgactctctatccaatttgccagtctgtgtctttcatttggagcatttagcccatttacatttaaggtgaatattgttatgtgtgaatttgatcctgtcattatgatgttagctggttattttgcttgttagttgatgcagtttcttcctggcatcaatggtctttacaatttggcatgtttttgcaatggctggtaccggttgttcctttccatgtttagtgcttccttcaggagctcttgttcagcaggcctggtagtgacaaaatctgtcagcatttgtttgtctgtaaaggattttatttctccctcacctatgaagcttagtttggctggatatgaaattctgggttgaaaattcttttctttaagaatgttgactattggcccccactctcttctggcttatagagtttctgctgagagatccactgttagtctgatgggcttccctttgtgggtaacccgacctttctctctggctgcccttaacattttttccttcatttcaactttggtgaatctgacgattatgtatcttggagttgctcttctcgaggagtatctttgtggcgttctctgtatttcctgaatttgaatgttggcctgcgttgctaggttggggaagttctcctggattatcctgaagagggttttccaacttggttccattctctccatcactttcaggtacactaatgagatgtagatttggtcttttcacatagtcccatatttcttggagtctttgtttctttttactcttttttctctaaacttctcttcttgcttcatttcattcatttgatcttcaatcactgataccctttcttccacttgatcaaatcagctactgaagcttgtgcatgtgtcacgtagttcttgtgccatggttttcagctccatcaggtcatttaaggtcttctctatgctgtttattctagttagccattcagctaatctcttttcaaggtatttagcttgtttgtgatgggttcaaacatcctcctttcgcttggagaagtttgttattaccgattgtctgaagccttcttctctcaactcatcaaagtcattctccatccagctttgttccgttgctggcaaggagctttggaggagaagaggtgctctgatttttagaattttcagcttttctgctctggtttctccccatttttgtggtttttatctacctttggtctttgatgatggtgacatacagatggggttttgatgtggatgtcctttctgtttattagttttccttctaacagtcaggacctcagctgcaggtttgttggagtttgctggaggtccactccagaccgtgtttgtctgggtatcatcagcagaggctgcagaacagcaaatactgcagaacagcaaatgttgctgcttgatccttcctctggaagcttcgtctcagaggggcacctggctgtatgaggtgtcaatctgcccctactggaaggtgtctcccagttaggctactcaggggtcagggacccacttgagaaggcagtctgtccgttctcagatctcaaactccatgctgggagaatcactgctctcttcaaagctgtcagacagggatgtttaagtctgcagaagtttctgctgccttttgttcagctatgccctgcccccagaggtggagtctacagaggcgggcaggcctccttgagctgtggtgggctccacccagttcgaacttcctggctgctttgtttacctactcaagcctcagcaatggtagacgcccctctcccagcgtcgctgccgccttgcagttggatctcagactgctgtgctagcagtgagtgaggcaccgtgggcatgggaccctccgagccaggtgcaggatataatctcctggtgtggtgtttgctaagaccgttggaaaagcacagtgttagggtgggagtgttccaattttccaggtaccatctgtcacagcttcccttgtctaggaaagtgaattccccaaccccttgtgcttcccgggtgaggcgacgccctgccctgcttcgactcacactccatgggctgcacccactgtctgacaagccccagtgagatgaaccctgtacctcagttggaaatgcagaaatcacctatcttctgcgtcgcttacgctggtagctgtagactggagcttttcctatttggccatcttggaacctcctatgtagctattttgatctgctatcttagatgtatttctgaaagaacagttatagtttgttcatttgacttgtttctagtcttttagcaaaactgtatcggaagagttcttttaggtgattttgtccaataacctcatcttcttatgaggcttttgatgtcctgtggcagcacctacttactggcactggagaaagtccccagaatatcctgtgattgtattttacatacatcttcactgttagtggactcctagaagacagtcttagtcttaggtcatagataccttttccttccctagtactattcacatagtaggggccaaaagaatgatttttaatatatctataaaatcaggggagtgaattaaattctctctcaaaggccctaagatgatggagcttcttggttaatgcttctgatatatgtttcctttaggtgtgtcttgtgatggaatatgctgaagggggctctttatataatggtgagtgtcattagacctgtctttatctagtggattaaaataatttgaaaaattttaatataaaccctaagttgtttaacattcttcacaatttgccgtcagagtcccaaaagggcataatttttaaaaatctgctaagaataaaaatggaaagataagattctataacattagtatgtgaaatttagaggtctatcaattttttaagtagatggtactttgcatttcattaaaagcatttaagtaaaagtttactttttaaatagattttaaaatatcttcagatttttttctttttgccctctcataactttgagcctcctcattttagaattctttaaccatatttcgatttcactctgctttattttttcttttttttcaaaaaaaaatgtgaaaactcacttcacacaaccttttatttgtagtaatgaaaaaaaactttgtgtagttacattggagaacagagttcttttaccctaaaaataccaaccatatgcagaaatgtattgtctcttgtagcaccagttatataaaacaaattgttacattttattttttaattagtattattttatgtaaacttttacttatatttactgcccatgtgttcatcattgtgatggatatctaataccccattgtcttatttgattgaactacttctggtttttagccattacagaaaatacaggtgcaaacatcttgatatacattgttttgtttctttctgtactgttctctgcctctctcttgtagtagtgtgccataagactgctcataatttatattactttataaaagtctttatctgtttgaaaaaatgtggtaatgtatattgattttacttcaatgtaggaataacatttaatagatgtactattaaatgttaatatcatggcaattatccactcaaaattagtagatattttcatcctttttatttagaagaaaaattaaaaggccaggcatggtggctcactcctgtaatcccagcactttgggaggccaaggcaggcagatcatgaggtcaagagatcaagaccatcctggccaacatggtgataccctatctctactaaaaatacaaaaattagctgggcgtggtggcacacgcctgtagtcccagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctcattattgtacaggagtttctcttttctctatttggcttactcagtgtttacttttaactcaccttcatcatttagtcatttatctaagcttgtattttagatgttgtctttagtgggatttttatttttggtaacctctaccttagattagcatacttctagaatctgttagcctataaaaatctcattttgtgcctgcagtatataatgttgctgttagacaattccttgggggcagagataggtctgacgtttttcttgctgtgtccctaacacctagcacataaacattctacagaaatttgcagagttgttattacttgctctttcagaggaaagtaaaagggcatttcttggcatctgggtagaaattgaaaatattctggattcttcataatgtgaatacttgggactttaaaaaacttataaattccttagataagtattttaaaagactaaaactttgggggttttgtttgtataggtattcagttaaagaaaacatacacataaaacatattgtttccttttctctctttttttttcttttatgcacctgtgacacagtaaaaatagtctccacgtatcttctttaccctccccccaagctcccaccccagcacattagtctttacagaagaggtttcccttaggaaatcagtatagtcttcagttattccattctcttgatactggttaaagcattaaaacatcccttctgggtgcaacttgtcactctcaggtctaatctgatatactctacataggttccaactcttagaatcactgttcttgctatgtatcttatctctactcccaaacttaaactgatttctgtttccccaggtcactgataaaataatgtttaagcttttatttttcctgaggctattatcttagttacctgccttaactaatgaaaaaatcacttagcctttttttcttcattgtgaatattcagtcatcctttttccactatattaacagagttgaattattaaagcaaacttatgagaatcacagctcttaaccagcaacaaattgacaaatgatccaaaggatataggcaagcatcagatacagccaaagcattcttttcctaaaagagtctgaacgcatctgatgcaacacccaaaagtatcccttttctcctcgttacagtatgttttggctttggaataaatgattagttattgaacaatatatggagaaatatcttacaaaaggaagtcatttccattttctaacatcttttacattgcactaattacatggtttaaatgactatccctaatcttcatccaactacaccccatgaattttaggtttatttaatcaacctagttagaccagatatatccttctaaaatcatttgtagatagagattctccttttgctagtaaataccattaacatatttacagaaggtctggtctaggtcatttattccaggcctctccatgattggattcatcttgcaaatcgtctttggagcccctggtatacaagttggactttagaatcagaattgattctagttcagaaagtactgggtaaaagaaattctttggaatggctatgattttatatataattggacatacatgaatacctgctatatctttattttttaattatttttattattattattattttttattttgagacacagtctcgctctgtcgcccaggctggagtgcagtggcgcaatctcagctcactacaacctccacctcccgggttcaagcaattctcctgcctcagcctcccaagtagctgggactacaggcatgtgccaccatgcctggctaattttttgtatttttagtagagacagggtttcactgtgttagccaggatggtttcaatctcctgacctcgtgatctgcccgcctcagcctcccaaagtgctgggattacaggcctgagccactgcacccggccaatacctgctatatcttattgtcagtggaaaacctacagattctgtggtcaggaagagttcctcaaaatggtatctaaagaaggtacctgatgatctagggaggtgttttatacactatcaagttgtgcttgtgcttgtattttatcttttgcaagtttattcacatttacattagaaattaaaatgtgtttttaatcttaacagtgtgaaagtaagcctacaaagataatttaagttcagatttcagtgagccctgaatttcctgttcaaggctggtgaacttttgaagtcgagtaaaggagtactaacataaaactcattcaggaaaattatcttgaatcatcagaaattatcttgatatcttgaatataccagtataaaacaaggaaactagttacagagttcttataattttcttgggtaaaaagtgtaagagtttgaacaagaacattgagatgcgggaaaaaagctttgttgaagtacatatagaggtatactggatttagcattcttttcactggaatgattatgagagtctttttggtattatggaactgtgaatagtagtttatctgacttattttagtcacattggactaaaagagaagaaatttccaaatagtctctccagatgtaaaaagtttataaaacttgtaattaaaatgaattcctatgtactgctattggatattactacaatgtgatggtgcaaattatattacccatttctatttctctttgtcatgaaaagcaaaaccttgtaagtaagagtatgctacttggtgactgtagttgggtaatagtacacctaggaaagtccgaatcttaagttcagaaaattttccagaaatctctcattaggtcattttagctataatagatttgtattcctcccacacattcatagtctaagcacaaaaatggttttgggattgaacatttttagaagtatcttcaaaataaagacattaaattacagaccatttttttccttctatattggattattttctttatatagtgttactattttttaagtaatacatatttatgattaaactcccatttcaggataccgtaatgttgacctaacagaagttttttaaaccccacgttttattttggccagatagaagtatgatcaggaaagattttggagctagagatgaagacatcagaatgtgagtctagcagccttccaaagagagctaggttatggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtaaaatggcaaaagtatggtatgtttgataatctccctcactccttgtgaattcatatgtttttatagattttccccatttccatggttttatttctgcataatacataaagtatacaatgaaatctaaggggatattaaatatagtgttatatcctaaattttatagtaagatttaaatcttctatgcttctaagcatatgtacagttgatcctcattgttcaccaatttcttaattgcaaaattgcctatttgctaacatttatttgtaaccccaaaattaatactcatggtgctttcatggttatttgcagacagtgctttcatgtactcgcagacagtgtgcatgcgctgagcagtgcaaattttgagtcatctaacgcatgcttccagctgaggttgaacaagacaacgtttttccgtcttgtttcagctctcatgctgtaagcaggtgtccttttttgtgctgttcagagccctttttcatttttgtgatttttgttggtaattttgctacttaaaatggccctcaagcatagtactgcctaagtacaagaaggctatgatgtatcttaacagacaatatacatatgttaaattatcttcattcaggcatgagttacagaaatgttgactatgagttcaatggtaataaatcaacagtatatatgaataaggtgtctttaagcagaaatacgcatgaaacaaggctatatattgatcagttgacaaaaacatggtgaccagaggcacacaggaacctacccctgtattttccttaggagcagtgattcagtgttcactaattcagtgttctcagaaactttatagaacataaataccaggaataatgagaattaactgtgcttttgtattggtttcctagcaattaaaaattgagagccctaaagtttaaatgaggatgccttaaaaagaatgcaaatagctgggcgcggtggctcaggcctgtaatctcagcactttgggaggctgaggtgggcggatcatgaggtcaggagatcgagaccatcctgtataacacggtgaaaccccatctctactaaaactacaaaaaattcgccgggcgtggtggcgggcgcccgtagtcccagctactcgggaggctgaggcaggagaatggtgtgaacccgggaggcggagcatgcagtgagccgagatcgtgccactgcactccagcctgggtgacagagcaagactccatctcaaaaaaaaaaaagaatgcaagtaattggacagaaataagatactaagaattacaaataaatgtcaagcttatatgtttaccttcttttatacctccatatgtcactgaagttttaaaagagttgtctgtaaattatatgctaggtttctgtataaaaacatcaaattatcttttaaatgaaagaagttgaactgaaggtatgtgatttgtatgttaggaagtgtaaatgcccataaaattcagatacattcagttaatcagactctggttatagcttatttctttcagttttgatgactttaaagggttttctgtttgtttttagccaccccagaggaagagaaattgcaatgcaactagtcacctgagtggagctcttttgccctaaaattcaatttagtaataaatgaataatcaggtgttatattacacaagattaaataatgcctcctgtttcatatacagaatgtatacatttgacattgttttaaaattatttacttatttaatatacctttatgtgagttaaaatgacccaatgttactgtatgtggagagcaaaaagatttgtttatacaaaagattaattttattgctctagacaacccttaattgtctagagcaacaaaatgcagactgttaggctgtgtaagtttcttcatttctgaaagatgtcagtcaacctgtagcccaaattagactgtagcatggttgtagtgctatattacagtgtactgcttagcatgtaaagctatagctataataattgttcattcttacagtgagttgagtgtttgtttgtttttgggagattatgacgggtgcttattgtgctggctgattcaaccacctacttagtttgtaaattttgctgtgtaactcaggttatccataattttcgttacttacaacgtaatgtttaagtttataaattaagaatttcccttcaccatatattgaggaaaaaactgtaacactaaattagaaagttcttctgctttgatagcagagtagtgctgtctgtcagagtgggaagaaaatttaagattaaaatgtaacagaaaggaggccaggcacaatggctcatgcctgtgatcccagcgcctcgggaggccagagcaggaggatcagttgagcccaggagtttgagaccagcctgggcaacatggcaagaccccatctctacaaaaaatttaaaaaattaaccagttgtgccagcgcatgcctgtagccccagctactcaggaggatcacttgagcccaagagtttgaggctacactgagctccagcctggatgagagtgtgagatcctgtctcagaataaaataataataaacaacataaaggaatgtacagatgtttcatactctgccccagagaaagtatcagtctaaatacataaaagtcaagtcctgtgcctcttgatgaaaaaactgcctcttgatgaaaaaagatagaaaataactgagtttctgaagtagttttttagtgtattgttgatacttaattcatttaaaaatgtacttgttgaaaagacaaagtacttcagaaagagtagtttcttagttctacatgtgacagcctcatttttatccctgatacccattctcaaaatttaagccattgtttctgtaagtcatgtggaaaaatagtctttaggttatatactaccttttttttttctaggtagtaattacagtgaaaaatgtgacgtcttcagctggggtattattctttgggaagtgataacgcgtcggaaaccctttgatgagattggtggcccagctttccgaatcatgtgggctgttcataatggttcgtaaaaagaaatttttcttaaaagtactttttgtgttttctacttggaagactactcctgtccccttccctaaagaatatcatttatctctaacattaaaatgtacaattctttgttaagagactgctttgctattatcagactctgccctgtccctgccccagagtccagcagagcaggattgagagtagtcctggtctacacatgcggctgaggatgttcactggctccgctgattagggaaaggccatcagtacgcaacctagacagttggctctctcttagggagaagcatcaggctggatcatggaaaaaataaaaaaatacatacataaaatctctgacatggttaatataactggagagttatagcccttttctcctgaagaagcaagggcctcatcaaggagaagaagcaaagaataataatgcttcacatatttttcctgtttatattctcacccacccttagaaggtgagtactgttgcctcattttacagattaggaaactgaggcctagagaggttaaataacttgcttaaggtcacaagattagtaagtggtagagctgggattcaaatccagatgcttctgacttgaatgctcatatcttaagtcatattgacttatggactcaatgtccttgcatctgtcctgtttcttttatagttctggtaatgttgtttttaaccacatatgatgttagaatgcatcctcttcattagtaaagttactttacatttgcttgggaaaatagcttttcatgaaggaaaattacttaccttcttaattttagcgccactcttagttatttcatttctatgccttgtttataatcatgtgactaatggccattttttacattattccacaagtctaaaaacaaatgtctgcctaattatttaggtcattcatagatttatcaaacagtaccatcatctgagtaatcttagctgtttttaccagtttcctatactgcctttaatattactaccattagtatcattgtggagactgttcagcattgaccaggacagcttgcttgcttgctttctatcagttgtcagtaaataattgaacgtccgtgaagtaaagagtaaaagaactaacttgttaattgataaaattacaaagcacttttattactccaaattacagatcttaaactacaagatctataaaataaataccactttggaaatacgtacaaagagtttgcatcattctttgggtaaatacattcttccccccttcctctcattttcaattgtaggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggtaaatggatagattggaagagtattgacttgatttttctttcatctctattcccatgaaattataatcaagaagtaatgaataatgtccccatttgcattttaattccttcatttcatatgattgactgcaatttgagtttacaggtgcgtcattcttcatgtaggtaccctgattaaagagttattgaagacctgcttccaagtcttagaattcctacataattatgaataaaaagatggcatattgtattacagtgaatgtcattcttaacttgaaaaatcacttttacatgcatactactagatcaagtagtattagaaattattgtaaatgtatttaaacatttcttcatcacgaacaccctagtttttgttctcttctacagaggctctgatttaagaagctatgttaaaagttccttagttttccgaaatgtgaagtagtagtgggacatgtaatttgtggtcatcaaaaagatagtagaaataatactgtaacttagaaatattgtacttctcaaaatatagtggcattataagcatttcattattaattgaaacttaaagatatgtgtgtgtctatatgcacatgtatttaccctgcatttattgaaaaatacttttactgatctatttctcccacctcaagaatagttttatttattttaagatggttactgcttggctagttattctcaaattccagttttactgaaaatattttgagttgctctgaattctaaaatgtacttctctaaaattctatcatttgtgtctcccacgtcctctaaactctctcttcatttccttactgtgaccttgaattttttgagcctcccaccttttcactggtcctcagtcctcttaggtccttttttctttctccctccacttaattccaatcaactattataattcttttgggaataattttcatctttctagcctctctctcaagcttgcttggctaaaccacaagcctaatgaaagctgacactcggcttactccttgcctgtaccaatgcagctgagtgtggctggagatagcacaggtttactatcctcacgtgcatgtttagtgctattggacagttgtactgtattgtagttcatctctttcctcctatatgtcttaattttatactgtagcctctcctcagacttcaaacacctcctcgccactcctcactctcagctgatcttgtttgctctttctctgagaaaattggagtaatcggaagacagcttccacaacatctgtgcccatctactctgctttcttctgttactctggctaaactatccatacttctggccaaaggtgtacctttctgcctgtgcattatatcccatctgctcctctgagcaattctcccctgtctcttgcatcatcagttttagctttctactggatcattcctaaaacatacgtagtctgtatttgcattcactagcttctcttttccccttctttcttgagctgactccattcagacgtattatgccagtacttcagaattgttcttgtcaaggtcactagttatctctacatcactacatttaaggaatcattttcatttctcatcttgactctcagtagcacttgacctaattcattactttctccttcttacagacagcactttcttcagttggcctccgagataccatactagcctagattccatcttacatctctggccgtctgttctcagttttctttgctggttattcctcatctccccaacctagaaatgttggagtgcccagggcctgctcatttggcttcttcacttatctgtctgcactcatttccttggtaacctcattcattattatggccttatataccatctgttggctcataatgttttccatcttatacctgaactctatactcatatatccaactatttcctttacatctactagaaactcaaacttaatattttccaaactgagttcctgatacttccttcaaactcactcttcctttagtctttccgcatctcaattaatagccctcagttcttctactagctcaggttaaaaaccttaagttattcttgactattagaagactatttaggcatcttggttccttttttgtgctatccttaagtttctcttaaaatgggtttgtttggatatcttcattagcttgaaaagtcttattttatttctgttcctgcctggctagtttataaaagaatgtaagttacataataccaagtgaagcatttgtattatttccagccattagtcataaatgtttctgcttttcctaggctcattcatggacattgcttctacaaatacgagtaacaaaagtgacactaatatggagcaagttcctgccacaaatgatactattaagcgcttagaatcaaaattgttgaaaaatcaggcaaagcaacaggtttgttatgttattacaagtaaaactggtaaccttaccagtagtcacaatattatactaactgaaattaattatttaccatcttctattttataaatcctgaattttcttcctgaaacatgcaaaagagcttacaaatagagacacgtaatgagattctcctaccatttattaccaaatggtttttccttctaatgattgctacctttgccaattctaaatccctatctataataatccctaaatgtaatggttgatggttaaaaatgtaaaatgggtatattttggctgcgctgcccagttagaggagttgttctaagtctatcatttcatgctgttcagatttattatatttttgccattgttgatttttaaaaatatttcaaggagtgagtttattcattttgcctgaggcatttaggttaacgaataattggggcttttagctcccagttctagtgactgccttttcataaagacagtatctgcagcttgctttcccttacccctgtagctccctctcgtacaaacttccctctcctttcagagcagaacaggatctatcagaatcccatttgccatcttcctccttttaggttgcctaagattgctaaatctaaagaacttcagtaattcagattgacctgtaattttaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggtaaaaaggaactacaagtctgaagagtgaaaatgtatataagcctttttggccatggtagtttcagttgtcaaaggttttttgtgtgtgtcttatatttttttttaaataggaagtaggtttacaatatatttttctaagttactagcaatagtttatgcatttatctcaaattccaaataaggaaggtatgacttgtaaaattatttggatgagaaagtatgccttcctcatttacagattttatcaaatgtaattctttctgctcaaacatgagttgaaagtctaagtgagaaattgaaattctgccaaaaccagaatattttggggattttcagtgatactactagatttttgtgctgaactcaaataatagcaaatattttgtttcaaatttaacagaaaaatgtattccagatccatgtatgatttgaccttctatctgcttcttcattccagtgacaaaataatagctaagctggttgtggttaatttttttaattgtaaaataaaatatcataattttattagatcttgaaaaagctagcatttaaattccattgttcagttcttaaaattattaatcatggaagaactggtcagcacaaaaacaattacatgttttgttacttaagtaaactgacaacctaattctgtgaccaggtttcattttagtaatgctggtttaatttggacgtttttggttttttgctgattctttccagggatcagggggagctgattttaaaagtaaacacgtttctgttgtggaaaatgtggaaatgtaaacaagccaaaaaaacttacataattaccccactcagagataaacacttaacatttttgtgtatttaccccatcttttaactatgtatgtgtataaatgtatatattcatgtgtatttgcatcttttttaacttagctaaccaattttttaggtctttttttcacttatttggtttttttctaaatagaatattctcattgtgtgtggagctcttttcagaaagaagttgtcaagatggaccatcatactatacttgtcttcaactaatcatgatcattgattttatcagctactattagaatccattagatataacagaatatccgaaataacagtgtctataacacataagcattatttttcacatataaacaagtctggaggtagtgggctctgtgatcttgaagtaactggtctcctatttctgtgctgtaatccctactgtatagcttccattctcaaagttatcctgtgctccaaaatggctgttgaagttccatttcatcacttctacattccaggcaataggaaggaagacatgggggcagggcaaatagacatccaagttctttgaaggaacattcccagatgcctctcttaacaacatccacacatcattggtcaaagtaacatggtcgaatggctacacgtagctccaagggaagaggagatctgccctcttttatctgatgacttttctgtcctaaataaaatcagagtactattgctaaaacagaagggaagagtggaaactggcagaagatagctgtgtctgccacagatgggtcttcagaaactatcaagttgagtagaagtcaccagccactgacaagcccatgagtctccatgagtcacaagtatttctttggagcagggttgtctcactgtagtgtcagatgaaccctactcaccgggacataccctcatgctttgaggaacccttttcacttcagggatgttgttcaggatagatctgccacatactaattgctgtctcaaaactgaaaattgttataataatggtttcatgtcttcgctagtatcatatttctagtcaagcactggttttttattattatttacagaaatgactttgctagaaggataaccacacacattaaaattttgcctaagtgtagaacaaatgctattgtacatcccttgagttttacacaatttaaattttttcatgaattgtcttacttggaaagagtcatactttccagccttttgacagactttgtgtttactgtgaatgtaccctaaactttggaaaatataataaatatttggtactagaaatatgtataagtatgactacaaaagcatatacatttcacactttgattcaataattattatttaatcattggattttactttatagcacacttcaagaaacacctaacttgaacatgtattcctgtgtttgtgtaattaaaacaaatacgacaacttactttttaacgcctttcttcctctcctccttcgttcccccacccccatcacagatcagtgatttcacttaggtagactgtttctatgaatatatttgaaattttgcttcctcattaccctgcagctttgtctctgttctttttatttttttctgctaattaaaaccagtgtgtaaaacatcttgtatttggtagttgtttgctctttaatctcgccttttctgagcatggatgaaaagttaggtagttctgcatgccattctgcatgaaatgttattaacatgaactatttgaaaatgagtctatttttgtagttaatcattttccgtgttactgtttgtggttgtttgcatgtatactgtatatatgtgtttttgcagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttttaagtgagcacatgagctaaacccagaccttttttgcacccaacagaaagaggaaacaactaattaaaatttgttattttccttggctcctttccttcctcagttactgctttttgggtcccctctagactttctgtcctaacctctttctgttggtagcaagtgaatgtgaagttgagagaagagagttgctaaatagcattttgccttaacctggaaaacaaaaagtaaagctaaatgagatgtgctgttttgcagggtatcttgccaaagaatcatgtaaaatagttggtcaattctgatttttgtgtattatcaggagaatctcataaattacatgtttttatacctaacttacacatggtactttagtgtctaaaattggtaaactgctttatttcttatggtgatcatttcatagaggaatatgttaccatttttaatagaaacttaaatggcatattgaccttcagtattgattaatgtattatcaaaattatcatttatttatccctttaggcttttctctacctctttacccaaaatcttgataaggaaatacatattttccacacacgttcatgagtgcgagttggatgaattcttcagcatgctgtcctttgcctgtgattgtgtttttagcagtgttgataattctagttgaatacctaatggttattttctcctctactaaactgaaaactatgtaaggatagaatccatatctttgtgcattattttgttgttgttgcttattattgattgtatcagcagttgctggctcagtgcttcacatattaagcatattaacatagtgtttaataaatacatttattaaataaatgaacagacctattgagcatctcccctggtgagaaactagcatacaaaaatatgaattatactattcttaggtgccattttgtctgtataaaactatcttatattaattttcccctggttatcaaagtggtttcttattttacaacatcattactattgctattcaaagagtagagttaacccatttttcacatggtaatttttatttattgaatctggactgcttcagaaattaacaaagagatcattttacatggagatcagtttacctccatgcggaaaggtactgtgtataagggacgtactttaaagaggtggaagcatttaaacttacataccgctgaactgtgcttcccttaaatgtttgagggaatcaggaaaatttagacagatggcagtgtaatcttatgactaagcattaagaataaatttatatatggcagcgtagcccacgctatacaagataatgggggagggaaaaataaggaaagaataatagtttataactgtcaggtactactggcatctagtgggcagagaccagggatgctgctaaacatcctgatgtgtaccaggcagtcttctccaacaaagaatgatccagcccaaaatggcagcagtgctgaggctgaaaacccctgattagatgttctttgtgccctacaaagtagcttaaagtacatcttattttacctttatacaatcttacaactaggttatcggatgaaattatagctgtttaacagacgaagaacttagatctgatgatgtttagtggtttttccagaatcatatagccaggaccccaacccagatcttctgactccaagtcacatccattttttgttcttttgtttaagtcagagaagctagagtaatttcttcttgctttctcttagtgttcacattaaggagagctcttcagccagggagatcctcttttatgacattgggcctttatggaatcaggtaaccttaattctcttaattgccagagcagcagtgctattcatatgaaaatattattcagtaataccttttattaaatattctttttaggcttttcccccctcagatatcaaacattaacttactcaggtgcactttctttaatagaagaatacaagctgtagaattgacactagtggacataaaagccaatcatgaatgtgctcataggtaatgtttttaaattaaatataaaaataccgcccatcctttgggaatatctcaaatttcctacatgacattttaattgtaaagaagggtgatacttaatttccaaaatttcttaatactttctagaaattgttttgttctaagtggatttcccacaagctttatggtattagcaaatacttcttgatatattcaaactgtttaattagcattaaaacccaattgcaaggattctttttaaatatagctttttaaagatcttatttacatggataagagtttcgttaatacttccctttggccaagtgcaatgtactgagtctaatgtacttcttggaatgaactacctctcttaataagagcaatccttcaagcatcacaaaaaaggttttgtatatatatctttaaagtcactaaaatgtctaacctagtcataggtaaagaaatgcaaagaccctaatcttgtaatcttgttttttgctcgctcttcaaaatgtgtatactatgccatcagtcaaatgtggaagaaaaagcaacttagcaaaacagcactatttatcaatttagtagtctctcagatcatacagaaattaacctttaataccttaggactccctgtgggtcagactgtacaattttttatacctcttctaccatattactggctctgaagaactgacaaacttttgtacggtaacccttccttctttccactgtccatctgcccttaaaagagtgagctttatagattagcctggctcctttttaccaaggaagacacgcagctaagagcaaattaccagtagagtgtgtgacattttgctgactcttcctttgtagagaaggtcctgccaagtagcagtgtgctacctaagcaaagtaaatgtaaatgtggaagtttcttgcccagtatttagaccatatgaactacagttttctaatgcatttgcttgctggtaagttggaagggacttcgagaaaagaaatagattttcttaaatgttttttattaaaacttgagttttaaaaaccatatcctttctcctttcagccagtacatctaatttgttacatttatatttgaagaaaagggaataggtagcagattattggattctttgaagtttttctagattttttttgttctaggactttaataagggcagtaagaacacagatcattgttttgcatggattttctttactttttcccatattttctttttgtcactatctaagcttccaagaatctatttttcacccaccttcatctcaagtacacaaatgaaatagattattgggattgtgaaactatgtaagacattctaatgcagttcatctgatgttagaagaatacctaaattttacatttcttttaaaaatccaaatgtcaaagaggaacaggtagaatgcctaaatattacaaaaaaagaggaacaacctttttcagtttaacatgtagagtaagagaataagtagttaagaaagcgaattatttttcatgcttgtagcatcagtaatggaagatgggttgttctgctctggagcctttgtgtgagtagttatagcatttaaggaaataaactgtaattataatgcattctaaaatctactggaaaaaaatactgtcatatacatatatacttaccacctataaaagatttaattaaacattagtcttctgcacttctactctgatataaaatttgttgtacatggttcataccggcttgattgcttttataaagtgaaatgagtttcccaaatgtgatatgcaaaagtaaaattttctaaattacagacatttttaatgctattatatcatcatagataaatttatttcttagttcagattagattataatgcttgatttcaagtacttgaaaaccatccattctatagatgaacattgccttgaagtgcttcaatttgagaaccttgaacagtgttgctttagtgtaccttttgttatttctaagcctaaaataatatggcataacattcgagagcaataaaatgccttgaccaaagaggattttctgtcttacatactgttcttaaggatatgcaaaagaagattgaatatacaaatgtttttgagtcagatcttactgaaatagataagatttttgcctagtttcctgaagaacctgaacttaattgatatttattgtttgttatatcattcttaaagctaaaaagaaaccttaggtgtccttatgatttcagccgcatttagatctcttaactgaataaaaaacgcgtattcgcttttaatttcagtcaaggacgtttagctctattgtatattggttttttactaacagtatgataagtagtaaattggagtaagtagaatgtagagaggcccaaacattttaactgaaaaatagatgagtagttaggcttctaatacttgtatcttgttgccctccttcagaagtttcaaatgtcaggtattggcaaataaattatctaggtggggagggctttatagaatgcttaaacaactggaagcagagatgcttttcaaggacacctgagcactattttgctttctccaccaggatgaaaatatcacttttttaatagtatatttggttcaagagccggtcggtaactaatgtttgtaaacctttctttaactggaagcatgtaagttattaaatatttcctccagactactgcagcaccaatatgaagaggcaaagagagaaagaattgagtttttctagatctggcaagttctcacctagcacagatagtgtcattagcagatgtaagcctttgatagggatcctagggctaaggggtgctatactaagatgtactgtactagtttctgtgtatagccacctcactttcaataaaattctctatttgtggcatattaaatagggaagttaatctaactttataatgaatatttaggtggcctttctgccatattgtatagtctaccaagatcactttttgtaatctaaaaaattcaactctaagctaataaagctggtttattggaaagcaaataaaccacctgacggacctttccagtgaaagagccagaatttgttaaaattagtaaagaaatacgaaactttggcagcctaaattagaacatatattttaaaattacatgttcagtttaccatgaagcagtaatgtaatgctagtgtatcatgctatgcatttttttaaatcttgggtattttacacatgaagagaatggtgtcccataatgtgtaatattcaaaactcgtgaatctcaaaatttctaacatttaggttaagagaagtctccaggaaaatgtagtgttgattcttacatgaagacagtcttcaggaagttttaaagtagaaaataagagtagtgtaagtcaaggaaaactatgagcttaactgataagaaaaattacaggagtggctgtctgggacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtataatataggtatgtacatatcaaaggaccaaaaaaggtaaaatgagtgaatgtctaaattagtattcagttgcaaaaaacttcagaatcaattcaaatttactgagaacacacccagtaattttcatttgaagtaataggaggttgatttttcttacattcatatttctaaattatgacttaaaatttaatattggagcaacaagtatttgttgattgcaatcctgttttgctttgtctgaactatctgccagatggtttctgccatggttgtgctaattaaaatgcattgcctaatactgcttgctttgattcatgcagtagcttaaagatttctcattttatggcatttgttaactgtcagctcttctttaccttacttccttaaaaggttttacttcccttttctcctatccttccacctaaatttaagttcagtttttgttgttattgcaatggtgatgtaatggtttatagacacatgtgtcgggtggttcctcagattaacaaatgttgctgtgttgctaatctgaaaagagaattccagacacttttacaagcctgtctcatcaccgctaattttagaatgaatgtgttgaatgaaatgtgcctaaaattgcttattagtcacggttgtggggatcctttttgtccttgggaaacaggggtagttgaaagtattcagaaaagtaatctagtggatctaattcaataaatgcacagttttgttgttttagtttgtaatgaaaagttgaaatttttggaataaaatgaaatttgaagtaaatgtgaattcagataatgcaaagaattataaaacgtagcttaaaatggaaaaaaactgatgatgtcttacatttgcaagaggagttacaaatttgagtttttatattcactacacatattattctattaaacattcttattccattgtaaggtccttttagtttatctgcagcataataatggggtcatgtgggttaaggtgctaaattatattgctgattggttttaaaaggatgtctctacgaaagattctggaagtctaaaattttaagaatgaattctgtctactaatcgggaaactacaattagagtgagtacatgttctaagtgttgcccactagttgagaaattacgtaatacagatttcagagtcaaaagaattttgagtattgtatcagctgttactcagtattttggtgtttccttttagacagctgatctctcacgttagaagatactgcataaacagctttattcccaaataaaagtgctgagtgaagccattgctcaattcattgttttgctgaggacttatatgtgtagaattctctcataaattgatttttaattaaattaattataaacatagaagtttctaaagcagaattaacacaatagcccatttcaacaagctgtatatttgagaacagagtgacagttattaacatccagtaggaaattaagagttgttgttcacaaataataaattactagattctgacaaagactaatggggattaagtaagcgtgactcaatataacaaatttaagcctaagcatcttctaggccctgaaatgaacaaggtattgctgccagttaaagtcagttgtgtcttacaacctgctagctgtcttgctgtaaaaactgtaacgtaaggcccttgaaatagatgccgtcatcagccccagcccccaagcattcatctatttaaacacatgacagaagatggtggaagagagttcagcagctattcatgtggtagaagtggttattgtattaggacatactctgttgtaggccagcaacttttgagttaaaacaccgcagctgtttctcttcctttctttacatctttctcttcttttttttttttcttagcaataaactcacttttttttccccacaaacattttgtgtagatccaaggagcaacaaattccaactttctgctgtagcaattacacgctttttgtctgtttgactagattttagtattttactttttttcttctttttaaaggcaacggacagccaagacgtagatccatccaagacttgactgtaactggaacagaacctggtcaggtaagacaacattcaaattttctatctttgaagaatactaggcagaaaacaagaattaactgtattctactctgcaaaattagttttatgagttgacctaaagttgtgatagagaaattcattgcacctgaacttaaatacttaggggggaaaaaaacataggtgccattgttaatttaacttgaaagataatttattaaagtaggtttattaaactccatggaaaagtaaattgttcattagcgctgtatatatgttatatggttttatgtatgttttaataagtattcaattttataatttaacaatttatcattaaagtgtcctttaaagtgaatcattaatatgtctcctttttactaataagggtagtaaacatttccccaataagttgctactcctctagcgccacgtagggcattacatggagaactctaacgtcttttaacttggcatatccactggattaatatttttttcaaatatccttaagataacatttactaagcaaatgtgtaaactctcgaaaggcttctattccagtggttaagatttcattgtttatatttctggatcctcctctaaactctccttgtctctttatcactgctgctttgcagatgatgcagacagtgttataatttaagccattactgattagtgcagagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagtcattaataaaaaagtcttttatacccatcaaccaacttaccaaaaaccacttcaaatatttaagtggtgaatatccttgatcttcatttatatctggaaatatgtttatttcacaaaatgcttataaacacatatataaataaaatctatatagacacattaatttattatgttttgtgatactagtgactctaaatcttgatttcattatttagtgatagtttttttcagtgcatctgtttttgtaagaccccagaacttttggctgaagtttcccgttttctccccctcagatacttaaaagttttaatcagcccatttagtaacagatagtttgacatctgctatttgctttgattctttggaggtttgatgagctcagccttttaaactctgtttactattgccactgatattccagttatgagaacttctagccaactgtttgactaggaatgagaagcttgtcctaagacatgtcaggagcagctactagtttgaaagcttttctgtagactctagaataaaagtgttgccataattcaggactgatcttcccacaccaagtcttacttatttcttcacaagttccacattatttgagattttcgttgttacccttttaattcacaataccttcaggtagtaaaacgctggaactgaggccaactatgggtgtgggacagtcatttgtggaattgtcatagaccactctgaaagatttggggtgagggagagtttgatatgggtgagggagagtttgatatggcagtaaaacctgttctgaaacaggtgatgtatgaccattgtgtagccacattttaaaactgatccactctttcaaaattatttgtgttatagccttaaaatgcctaatgttcagcttggcatgagagtggcaaatactaatcctaatgtactatgaaaacatttctcccaaaaaatgtatgataagtgaccattaaatcttttaaattactcacaaagatgatattcatttgaggaagaaaagtattcacaatatgtgttttcaaaattggaaggtgccatcctttttgaagtctggctaagcgtgattccatcttgcagaggaaagtaaacttattgtactgtggctcttgactcaaaacataatcttagtaaaaccacttagaatttccatctgtaaactaaaattaaattggttgtttttctgctgccatccatttgagaggaacagtaaatgaagcaagcttcttaattaaaagtaatgatataagtataggtgtaaaagattgcattcttacaacatacaactcactttcaaacatggttttttcattaattcaggaagctttttaaacactcaatagatgtgacttcctagaagctttgaaaagatactgagaaagaaaaaagcagtccctgacatccaggaactggtttgacactgtggcctcactgttgttagtagctagccttattctcaacggctggctgtcacagctagagcatgttactgtcttattggacataatctctcagaacaccaatatcagacaagataatgctgagaccgtgataaaaggagacaaaacaagactacttcggaatgttttctaagcacagacaaaaacaaggtcactgtgccacccacaaaatacctaacattgtcctctcccagctattaagagtgactgctgcttctttaccaattacagcttggtcctcactctggactgccctccctgtggaattgcccttgctttctgacagcggccaatctggaacgaacccctccttcctttgagtttccccaaaatcactcaaccaaagcctaaatcctataatactttctttttctaaaaccctcttactgagacaccccatgctgccccatggtaagcattctccttcactgcaataaatattaaacccaactctttccactattggtgtgttcctggcagtctttggctagagggctttgacaataccaataaagcctattccgcaaggacctcatttggagagatcagacttatgcccaaatcaattagaaaactaaagtaataacagcttccatttgttgtgcactgactttgtgccagataggctcttagtatacattatcagaatgttaatcctgttatcaggatcttagtcctgtgaagttggtactttttcacctaatttgcagccaggtaaagtgaggatgagagaaactgacctaagtctcttacttccttatactgccagtaattcctataaccaggttttgaatccagacctgattgcaaagcacacaaactctatactttaatcattctaacttgcatgtgaaactagatgtgatgcatgctgttatagccctagatctcttacatttaggtattttggcttctaatagtctgcattgtcattaattatttaaacagttgttaagtgatgatgaattgtagctgtatcatatcattgaacaaggttaacctatcttgataataaatttctaccaatgactgcacaaatttatgttttatacacctgggtgagccattctgtgtttcactaaaacaatatacattcttataaatgcctgaataccccttctggaattgtattcagtatagatctatattcaagaattctcttagaggaggctgcagtcagtgaaaattacgactgcaagatgatacagttatgattatttagagaagtgggcatattacatttccatatggactttataatctacttttactagtcaaatatgtgactttgggcaagttccttaatttccctgagcttctgcacccttatctgcaaatagggaccataacacccacctcccagagttcttaacagatgtgaaagtgccagggcacacagtagatactaatccatgttgtatgccagcctctccacagtgtgcctcaccgggctcttgatatcacttccttgctctcatgatagtgagaaataaaaagaaaatagcacttggaaagaagtaaaatccaccagcgttctttctgtatcataaggaaaccttgtgtcaaggatcatggaaagtatttgctttaaaggtctcttatcgcatattgagtgatattaatatacattgttattatttatttaagggatgtgatttattatactacttttttccatcttcattctgcacctccttttgtgtaaacaaatgttctggtaaactctaaatcagaaacttatgtaatagttttgaataattccttcttcatagtatacctttctattggagaatagacacgtttcttcttttttttttttttttccgagacacagtccccgctgtcagccaggctggagtgcagtagtgtgatctccgctcattgcaacctctgcctcctgagttcaagtgattcttccacctcagcctcccgagtagctgggattacaggcatgtgccaccacacctggctaatttttgttttatttttagtggaggcagggtttcaccctgttgcccaggctggtctcgaacttctggcctcaagcgatctgcccgcctcagcctcccaaagtgctaggattacagtcgtgagccactatgcctggcctctgttggagaacagacacctttctattgtagaagaccatgtaagaataataaaattctgaaatttccttatgaaaaactgtagtgaagccaaaatagatcaagcctacagacctttagattagaaagaatattttcagtacaaccttcatgtatagatttaattatctgtaactaccataataagtacccatgtaaatccacattaccaacttatacccattttaaaaatatttatattattgagatgttactttagcaagaatatcatagaagtcatcatttaatctctgtgttttgtgcttgtataattttagctactaagatttctgagggtattaaatagcttttaaatgtcagtctaaataataacactgggtgtaaattcctgacttatgaaaatattttcccagtctttcaggtaagatattaaaagctgagctttatttttgtctgtaaaataacttccaattcctttttataaatatagggataaatttctggtcaaaggccaattctggttcatgtctactgatggtaatctgcccctgaggtttaaatttggcttagtattcttttgctgccttaaattgctgtgtcacgtttctatactcttgtgactttcatatccagttcttttggtaagtcaagtttgcctatatctcttaaactttgcaattaatgtggggatagaataagtaattttaaatgtcttagaggaaggagcaacttaaatgagttttaatagtttgagagcatttgtgaccctcagaattttaccagtgattttaaaaaataagtactgtaaaaacttcttcagtagttggttacaagcagtaacataaattcagccacaaactagtttgagttttttcattgattgtcagatgttatgtgttcctcttatttatgccttgtattattcacatactcaaaaactacagttatgccttgtttttaaatatttccttagtttttttatacaaacatattagcatatttttatttattgagatacacatttcttaaaatataaagatttatttattagttaatggatttaaatctaactgtgctggtctaaaaacagttttgaaacttgcattaaaagtgcaagccttatatttcttagtttcatagctgttggaaattacaagtgggacaaacaagcatgcacagaaggtgctaagagtttcttggaaagtagaaggtgaaaagaaaggtgtagcaaagaatcattttgcaaaagatttaagcttaaggagtactataaaattcctattaggtccaacttatttgttttaatattgcagatgttcagtgacctcttttttaaatatactaaatccattctcattttaaaaacctaattattacttctactgtattttgttgatttctcacaactgatactgattcttacatgtcacaaacatgtgtttctctttttaaaatgtgcattagcattacactgactctgaaaccctggtctgccaccactttgaaggaaaaatgcctttgatttataatagcagttataactatgggcatatttgtgtacttgctttcagtcaaagaaagttaaaaagactcaggaataatttcataatgtctatacttgctttgtcaagggtaaaagtatcctaaaagtaagagtgaaacatttcatcactggttttctttggtgtatgtcgttgttattcttatatactaaaggtaaataagcttaagcaccaatcttgtatctgagtgctaatagcttgtgttctcattttattcaatgagtatctattatgtgtttattatatattcagcaatttcccagatcctgggaagtacaatataaaaagtacgcatggtctctgcccttaagaggttataatacttttgaagaggagtaaaactttgagactactataatttcgggcacaagttgaagtaggaactgactatacagccaaaattcaaagaagaaaaaaatctcgtgtgaagacatttcatgtacatcatttcatttaatttttataaccttatagatagataatactgtccttattttcctattgagtcttagaggttaaataagttacccaaagctgtactagttagaaatggcagagcacagtcaaactctgggctgtcttgtctccaacacccaacttcttactgctactactttttctcattcacacttcatcaatgagaaacctaagtctcagagaggctaagttacttacacaggttcacacagctgtaagtggcagaatggagacataaccccaggtctccaaagtattagactgaaacatgtgaagttgctgagttttcaactacaaaaacaccagttttatctggttcagttttatgcatgccctgtgcactacgccgtattatctttaggtgaatatgaggtcaggattaaaaactgcaagggaaacaggggcatgaggaattttaagaggagagaaaatccagatgggcaaggtaaacctgctgatggagagtcatgaatgccagagtgagaatttcagaattgattcagtaacaatcagtaaacgaacattttgcctgcagtacactgttaggcactccatgtcctcaaacacaaggtctggccttgtacacaaacaaccagagaagtggcaagaatcaccacataatgtagaagaaaacctgagctgggccttacagggtggggaaggattaacaaggagaagaaaagaacagaatgagcaatcttatatggagttaaaaattggttatggtgtagaaaagctttttggaatttctgaagcaatttcagtgggtacccaaaatgaaagtcatatttcatcagtttttcttcaaagttaatttatgatttttttctctgaaattgttaggaaagtacctttcactaaaagtataattagattgtttgtaacacaaaggataaatgcttgagggaatgggtaccccatttttcatgatgtgattattatgcattgcatgcctgtgtcaaaacatctcatgtgccccataaatatgtacctactatgtacacacaaaaattaaaaattatttttaaaaaaacagaaatgagaggaaaacaaagtacctgtcactgtttattatcctgaatccattgtggcttttcaagacctaaaatcatataattttagcactatatggaacacttctcatcacattcttaacccagccccaacccctctccagataaagagaggttgaagtgatctgaagcagacattacagcataattagaactcacatacgatggattctactcaaaggtacttttgtattgcatttcattttacttgttgcagtcttgaatttgagtgtttgtatatatgttgaagctagatataagattcttcatgaatttattttaagttttattttctataactccatgttcttttttaagtctcttctttggtactcagtaacacatcaagaaaaaaaaggtgctttttaaaaagtccttatgaggccgggcgcggtggctcacgcctgtaatcccagcactttgggaggccgaggcgggcggatcacgaggtcaggagatcgagaccattctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaagtccttatgaaacccattttagtttctgtgtcctttgaaaggctttaatatatgaaatataaatatgtagacaagaatgtatataatgtataagttatgaaaataaaatgagcacttgtgaacccaccacccagcttaaggaatggaacattagcaatcccagtgggggttggtccctgtgtgttcctcgcctgtggccttccctgtcatttccccaccaaccctcagtgccatgttctgtcatatgtcatgtttccagatatcataaataccttttatctgattaagaagtcctcttcccactgggcacaggggctcacacctataatcccagcacgttaggaggctgaggcaggaggatcgcttgagcccaggagttcaagaccagcctgcacaacacgggcgagaccccgtctctacacaaattttttttaaaattagccatgcatggtgccgtgagcatgtggttccagctactgaggaggctgaggtgggaggattacttgagcccaggaggtcaaagctgcagtgagctgtgttggtgccattgcacaccagcctgggcaagagaacaagaccctgtctcaaaaaaaaaagaaagaaagaaaaagaaattctcttctcatacatggaatttaagtttgttaaatgtcttttttataagtagatgttaaatgttgtcaaatgctttttctgcatctgttgaggttttgtcctttaatctgttgatgtgattaattttattaatggaatttcctaatgtcagatgagtgacctttgcagtcatttgcaaagttggataaactaaactttttaaatggtttttattgcttctacactgccacattatatttgctaatataatttttagaaattttgacttttgtgtctttttatttttattttatttttttggaagtgaggttcagttgtaactttctttctcacactgtccttacatattgatttttactgccttcacagaatgggtcagaaagtttcttctttctttgtttaggataatttaagattggaaaaatccttatcttgaatgtttgatagaacttacctgtaaaaccctcctctgtgcttggtattttctataatgtataggaatttttgaaacttttttttaaagaatgtgttcatttttatagtattgtctccgatttcaaaatactatcttttactatttttcattttgggaggcaaattcttttttttaactaagttagatctctagcttataaattgtcagtgtttctggttttttcatatatatatttagaattaaatattttcctttaaatgctcttatagtcacatccccaagtattagcatgattcacgttaaaagtcagttcaagtactttctaatgtcccttttgttttcttctttgaccaatgagttatttagaagtgtttttcaaaacaaaagatttttaaaggttttgaaatcagtataaaaagtaattaagttatgatactgaaattttttttaactttgagatttgctttatagcttagtacataatcagttttcattagtgtcccatgaatgcttaaaaagaatgtgtattcttcatttgctaggcgtaaagtcacttatgtttagattaagcttgttttttatggagttcaagttttactgtgtgtgttttgttttgtttttttggtctccttttatataatttacagaagaatattaaaatatattactgtggggctgggcacagttgctcacacctgtaatcccagcactttgggaggccaaggtgggaggatttcttgaagccattaggtcagcctgggcaacataacaagatcccatctctacaaaaagtttaaaaattagccaagtgcaatatcatgtaactgtagtcccagctactcaggaggctactcaaggaggatcacttgagcccaggagtttgacgatacctccttgagcttttttactttatgtgtttatatgtacagcatataaattttgaattgttggccaggcacagtggcttatacctgcaatcccagtgctttgggaaactgtggagggaggatcacttgaggccaagaggtagagaccagcctgggaacgtagcaagaccctggctctacaaaatattttaaaattaactgggcatagttgtgtgtgcctgtagtcccagttactcgggaggctgagatggaaggatcgcttgagcccaggagtttgagggtacagtgagccatgatggtaccactgcactccagcctgggcaacagagcaagaccctgtctttaaaaacaaatctcactgtgatggtggatatgtcctttttccttgcagttttttgatttatctatttgtatgtacagcatataaattttgaatcgttggccaggcacagtggctcatgcctgtaatcccagcacttagggagactgaggcaagagggtcacttggggccaggagattgagagaagcctggtcaacatagtaagacccatttctacaaaaaaaaattagtttttaaaaaataaattttgaattgttgtattctgaattgaaccacttatcatattatctctttctctagtaattttttggaccctaaaatacattctctctgatattaatataggtaccttatttggggtagtttttgcctggttttctttttttatcctttaactttctgttttctctgtctctgtaaattagatatgtctcttataaatagcatttaattcatcctgacaatctgatttttttttaaatatcttaactggagagtaattcatttacatttattgtggttactgataagtttgctctcttatgttttatttctctttcttttctttcaagttttgagttgaataaatttattcttcattttattattttctttctggtttgggagttatatattaattactacttttagtaaatacctttgaaattttaacattcatgcccaacctagtaaagatctgtaccctcatcctgaacaatatttaaaacaaggagttttaagtcagtgcttttcatgcttgtgctattgttattataattttagtgccatcttgtttgtttgataattctataaattcactgtttctgtcactgaatgttttcagtgtgtagatttatttccctgtttatcactattccttattgcatcttgatccttctatcaagtaaaatttttcttcttccaaaaatacatgcttgaaaaacttatgtggtaagaatgtatggaaggtaaactcagtttttgcccatctaagaatgttattttggcctctatcttcaaattttgttggctagacaattctagactggcagttatttttcagcactttgaagatattgttctgctttcttctggctgctttttctgtctcctgttgattgtttcctagaatttgaatgtatacgttccatgttgaactcaatttgtgagcttcctcctatttcttatgctggggatttgttgtggttggaatttgttgtaacctgcatccaatctggaaattttttgtggattcacagttaatacatttctcccttccacccagagccactaacccaagagagacaaatttgtttcctgtctgcttttgtaggtcagattttttttttcctagttgagtgaccttttctctgagagtgaagcctttgctgagttttagctttaagcagaggtttctccagtcttacttccatcctacaaaggcccaaggctttatggtccattcctctgagtgcagcagcctgtgaaaacagtagctctaggccattggtgtttagttgaaattccgagggctgtcagcttaagcacttactagtttcctgatattgttttgtttctaatctcagagtatttcttagtttcttgcaagctcatcagtttttaataggtatcatgcgtgagtgaatataaatttttacatatatataagagaggatttattttgttgtttacaagagttttggggggatctctaagtctcttcttgccttttaatggaaacgttctcgtcattttttttaatcaaaaaatcacattttgtttctcctgtgacttcttcctgtaggtgagcagtaggtcatccagtcccagtgtcagaatgattactacctcaggaccaacctcagaaaagccaactcgaagtcatccatggacccctgatgattccacaggtgaccagtctgtttcttcatacttatgaagttgaatcagtcatgtttatattcatttggccatgtcattactctaatgtttacaaaggcaggcattatactgttgtttagatttttatattaaataaactatttagtaatacatgttaaaataccattttgaatacagagacagagactgccttgccttctgtattttttttaatccagatactaaacatgtattttaaagattgtctgtttggggtttttttccagttgcgaagcgtattgaattcttgatacttcagcctgtgattttcctactagattcatcctactagatgatagtagtaaagtcattttttcagtaaccaaaatcggagaatggtaaaaatcatccccatcatcttcatctcaatcttttaaggacacgagatgtcatgtaccttaagttgaaaaaaattctgaccattgaccttttgaattgtttttaactgataagagacaccattttcagttatacaaatattctattagacctttagaaacctgtgatgagttattaaagctccccaacatgaataactaactgttcacaatattagtattaatgtctacctgcctaaaggtagtgacggcatcgtttcattatgggcaaacaggaaatgatgtgccatagtagaattaacttttccctaactttaagagaataccttgataaatgcttttaagtgtacttatgaaattttttatttatattatattaagtcacgaagggaaagatgatctcttagcccttggaaaattaaagcatttgatattttatataagatcgactatgttattaatagtaacaattagattgaagtttaaaagccagctttctgtctttacaaactaaaatacaactcaagtatttatagttatctgatgtggtttggtcaagtttataatttaatttaaaaaattaactgggtggtttttctgtgtgtcatgtaagatagaactatgtttagccagggtgtactctctagttttagtaagtttaaatttagtggcggcaaaaactcctgtttcacccctagcacagcccaacctaggactgtccagagcattcaccactacgcagcacatgtgtagaattcattatagacttgctcctccccagtggtagacagggcaatgctcttgcccagttttatcattaacattcaggtgatagcagctctttttgatttctgaaccccctggcaagggagtacgttctctgacattacagcatttgcccgggtctggtactcaactcagcagagccttctgtcttcagtctacactaatctgtatatgccagtcaatagtgtggcagattgtgacttcatgggggtaaaataaaaaatgtttaaggctctctctcacataactgctacatttctgcctcatatgttgcttctaccttccaactcccgtcccattgttttctttttctgtacctagaaacaccacaaaataccaattgctagaaataatttgcaatatcagctgaattttgtctttgccttgaaatatattgcacatgtgtggctataattttgaatacattttaaaaatggatgctctggtttaagtttataattaattcagctgtgcagtatttgtaagaaaaatattgataaccaagctaatagaataaattagggaacagataggtaaagtctttttctttgaaggcccactgaccaaggaaaaaattaagagtgtaaatgtaagttaaagtgacctaattaaatttttttaatttgagaggtttttgtatattttcagagaaagctaaagagcataacaatttaataatcatagccgataataagcgctcttcagttcctatttataatataatgggtattcaaaaagacacacatactgagaggatctagtgagagagagatctagacgcagtagagggagccgcagagggggaaactcactaaagaattttcacctttgcttagtactttgcaaacatgtattaatataaagtgtaagacatggcccattccttgcagtctggttagagtcataatactgacacattaaaagtaaacttatactatataataacttactaaatttatagtacaagctgagtgttttgatagttgtaagagaaatcagttcaacaagacttggcatagtctctggccttttcataaaatgatgagacttttctttagccataaagcagaaaggagaaggcagcattccactgaagggaatgcatactcaaagaatatgagatagtaacaagtgttgtgtttgaggggtcagaaaagagagtttgccttaatttaaccaaaccaacatgagctttgacattcaggagaagcaattagatttgattagcaattgaaacacacacacacacacacacacacacacacgcaaaaaactttcattaaataatcttccgatctgtgaccaattattgctagtagagattggaagttcaatatcaatttagtgtaaagtgagaaagtgaaatcccacttctttttttagagagaagatgaaattcaatgaaggaccttaagttccccaccatacaagggctttaattatttgaataacacaatccttggactttttttctgctcccagaataccacgcaacactgatgtattaagcttaattctaaaatacatatcagatacagggtgctgatataatgagatatataatgtatcagtgatttaagaaagaataataggaatggaaatcttaaattgaaactttttcaagacacttaaatttttctagtaaatcaggaggaaatcagtcatttttaatcagttttagttttgtggaaagcagtgtttatgtgggagcgtagtttgaaaccactgttggggtgggagaagagttggtcagagaaataacaaattaagtatatttcttgtttagccacttcagaaaaacacacatttatgttagtactgtatatgagccttaagggtaagggtaagtgccttaagtctctactgtttttctgtattgccctgcaatatttaataaacattactttttcaatatggaattcatactatactattttaaattgttctttctaattctccatttagtatgaataataatgataactaccgtcatgtattgagtgcttaatatacgccaggatttgcatggtgttcctcacatgcactggctcatttggtctgatttcgctaattagcttttggagtttcttgagagcacgttctcagtggctttaaaaaaacaaaaacaaaagcaaaaagaaaaaaaaacacctggattatcagttgacaataaattagaagattactgagccagcaacccttcttgagtttttttggattgcatacagtgcgtctgctgtcttcctgacttgcctttatccacaccactccttcaaggagttattcgtcagaaaaaggctgaagagctcactcatttagctctttttttgtctactaacagtgggaaagcaactacttctgaagtagaaaagtctgtattgcttcagagttactctgtttacttctggaactgttctacataaccataaatgttgagaagagactgtcccacgcatctcagtcaagttgtatggcagttttacctcttttgaaatataaacaaaagcattctattcaaataattttataaaattgactgattgtttgaattaatcaacttaactgttttcggcatgacattgagccacaggtttcaacctcattttggttccttactgttcgtatttgtaatatactctcatcaccaacatctcgttttctgcagtgattcttactgggaagggcaggatgagtggtggaggtcacattataatctatataaattgaaaatgatccactggaagagaatgtgtctctgctttctccctttccctgttaaggaacattgatattagcggagttgatatagccttctataaaataaacttagcatgataaagaaaagagatggggagtttgattagatagggtcaattaagactgaatttaaaatataaaggtctcatcactgtttttgtttttaattaagagcttagaagctctaatatattgtgttctattcagtttatagccaacttaaattataggtatgagaatataattgcattctaatatctgataattgaatatcctttttttaacctttagaattcagaaatagactcttcaattaccaatagctgtaacttttaatttacatattatttactttagggaaaaaaagcatttcattcatgctttcttgctgttcgtttataattatttgtgacagaaaatcaataaaatacatgcttgaattccagataccaatggatcagataactccatcccaatggcttatcttacactggatcaccaactacaggtaaaggagtactttcttattgaaagttgacttttttcttcttagagagtttaagttgacaattgtgttgctacctgtcattgtatagtcactccttaatttatccttttagttggcctccttaaactttttagaatcaaatcaaaataattcttttggttaagttaatcaaactttaaattggcagaatcatattcttatcttttcagtcatcttaaaatcctccagtatctttctttagtactgctaagcattacattttcactctttaattttagtgcattaaaacaaaactcataagcttatttctatttaatacatttgtgatacattctcatgttcatagtgactgaaaatgtaaataatatacttcagtgccccctcatgagtatgagggctataaacatcatttagtttgagcctgtttgcagcctgaaatgtcataccagagactacaactccaacaatcatgattctctgtaacagactgttaaaacagcaagaatagatttaaatgctgagttaattctgacaaaaggacactgagattttctagggcatggtttaacacttatttttaaaagatcattgctttagtgctataaaaatatatcacagtctctgtcttgactctcatcttagctagatattgaaatttgatttaattatgttttaacattcctgattattttcagcctctagcaccgtgcccaaactccaaagaatctatggcagtgtttgaacagcattgtaaaatggcacaagaatatatgaaagttcaaacagaaattgcattgttattacagagaaagtaagttattttttatgaataaaaataaaaatacattagtattttgagtttaaaatatgataaggtgcaatgaaaacgtagtttttagaattagtcattaagtatactttcaacttgtttaagctttaagcacccttttactaaaaattttttatgcaaaactcaatccttttgactatcatattagtgctatggaaaataaactggtgctttatacttgttgttttatgttctcagagctgtttagacttattattataaagatttattgttttcttgtaaatagataaaataatttgatttattaacattcagttgtgccttatcttagaaacatttttgtagatacattttttccaggtgtatgtttagaattggattacttattaaaagactgtatttcataactgagtgtttttctgaggagttatagaaactgccttcctccctttttaaagaaacacagcctaatttccttactactgcattcacagttcttaaatatgtatgtatcttcagttttcttaagcatgacctccatgaaattttatacttaggtaactgaattgttggtggtaactaaaatgaagtgataaggaaaaaattttggcaactttatatatgtatgataataggattcccttcattaattttaatctaaataaatgaaagttgtttttttctgaatttgcgaaaagctttctgtatgtacttcaaaaaaaagagagaaaaaattgttttatcataatttattgatacagtgatttaaatggaaccaacctggtatttgaaaggtaagcctaaataggaaattaaatactacagtttggaaatcgtagaagtaattatcaaactgctggcacttttatgttgaaaaagcttgatttcttatttcacttatttaacctatacttttgccatactttaatcatttgaaagaagtattctatgctggaaaaaacaaatggtggattagggtgttggctgtgaaaactatgacagttttaatcaattttaaatactttcagaagtagtattagttagttattttgcttgaggactttttattaattattcatttatatccagtaacctcactttaggaaatgcctaaagatgcatctttttcgggaatacttaatagttcccaaataagagggacttaaataagtttatcagactataaaagaatgagggtctttcctgaaagtgcttgcaaatgtaagtgttttaaaagaagtggtactttgtcatttttctcactgctttaaaatgggaaaaagctttaaattggatagcatttattttaattagattgcaaatttgctattagcttaccactctctgctatagttaagtaggattgtgacttcagaatgtgaatcagtataaaagtagaatgtgaaggataaaaacttcatgatattttcccatagccacatagaacccttcccagccttttttcatccttcctacacaaaaagaggatagaaaatgaaattttctgaaacttttattttaccattttatctgcttcgctaattatccaagtacagttacttaataaaaggattatgttatttgtatgattacactagaagtagatgagagttccatcccagcccataattatatttgattagtgtacctaagatgcaaaatgataaaccaagaataaaaattctcattaattgagcttccatcatcagctactaaggtatgaatttttccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttg

SEQ ID NO: 37519 - DNA, 71555 bp, Homo sapiens; identical to SEQ ID NO: 37518

SEQ ID NO: 37520 - DNA, 7330 bp, Homo sapiens
ctctcttgcctgccgccatgtgcctttcgccttctgccgtgattgtgaggcctccccagccatatggaagtgtgagtccactaaacctttttttcccttatagattacccagtctcgggtgtctttatcagcggcgtgaaaatggactaatgtagctgttaatagtcaagttctcaaaatcaattgtaaaagcacagtaaggaaacttagaaaaattactgataattctaccttctagataaccaattttgatgcattttaaatctatattagattatcctacatataagaagatacaagtttcatatattttattcacttaattataccaagaacatttttccgtgtcattaaaaatcttgtaaaccatttttacggctgcgtaagaattcatcatatgcatgtactataatttaggtaatctcttatttttggatatttaaaccatttcctttctattatcattaacataaataatactacctgcattttctattatttccttagaataaatcccacaatgagtaatgctaaataaaaggcatgatcatatttaatgtaaagaaaaaatattggccaggtgtggtggctcactactgtaatcccagcactttgggaggctgagactggtggagagcttgagctaaggagttcgagaccagactgaccaacatggcaaaactccatctctacaaaaatacaaaaattagccgggcttggtggtgcatgcctgtagtcctaactactccggaggctgaagtgggaggatcgcttgtgcaagctgtgagcctgccactgcattccagcctgggtgacacagcaagtccctgtctcttaaaacaaacaaacaaatttttaaaaacccaaaatacaaatacagtgtcttttttgggaaaagcttaggatgcctcttaaactatggaacatacaaaacacaagttagggcagaaaaaaatatacatggctaatgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgattctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctaagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcaggcctgtaatcccagcacgttgggaggccaagatgggcagacaatttgaagtcaggggttcgagaacagcctggcaaacatggtgaaaccctgtctctaccaaaaatataaaaattagatggacgtgctggtgcacataagtaacccagctatctggaaggctgaggcacgacaatctcttggaccaaggaggcagaggttgcagtgagccactgcactccagcctggcgacagaacaagactctgtctcaaaaaaaaccaaacaaataccccccacccccaaactacacaaaagacaagaatttccaagaataaaatcaagagatctgtactcacaatttatgacagtttcaattagaaaagtctgggttttatccttgttttcctaatattttcttttctttttctttttttttttagacagagtcttgctctgtcgcccaggctggagtgcagtggcgtgatctcagctcactgcaacctctgcctcccggattcaagcaatcctctgcctcagcctcccaagtagctgggattacaggcgcccaccaccaggcccggctaatttttgtatttttagtagagacagggtttcaccatcttggccaggctggtcttgaacttctgacctcgtgatccacgcgcctcggcctcccaaagtgctgggattacaggcatgagccaccgcgtccagcctttctaatattttctttaaaacgtcccctttttcaaaattttttcaaattcatggaaaagaggataggaattatggttaaaattagtactaactgatgacattaaccgattaataaccaattatgttcttaaaaactggaaatgatatacaccactagataaaataatcttaaatgttcattgactttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacactaatcttctgtacagaaatcctagtccagcaaacattgctctcatcttcgcccatacacaacctatgtaaagaatggctttcctactctttgctggcgaacttcagctcccggattaggcatgccacctcttccaggtagctctcagcaacgcacttttccatcagcctgggtgtgcccctctgtgttcccatggcgctttgctttcagcgcttctcccaaattatgtttacctgtttattagactctccacctctgaagaccaggccatttcatttggctttttactgccacgtagtaggtacctgttcaagcttgatggaaggacttccccagcctccccacacatattatgtaaagtgatcgctgtctttgcttcctcctggagaccatttattttatttttttgagacggagtctcgttctgtcgcccaggctggagtgcagtgtcgcaatctcgactgactgcaacctctgcctctcgagtagctgggactacaggcgcgcgccaccacgcccggctaatttttgtatttttagtagagacggggtttcaccatgttggccaggctggcctcgaacttctgacagcaagtgatccacctaccgcggcctttcaaagtgctgaaactacaggcatgagcctccacacccgtccaggagcccatttatatgggagcctgcttctaaagattattacctggtgccagggtattttccagacctgtcctcacattcctgttaaacaggaggaagtgaatcgcgctccttttcatctaccttctcggagggtttatgcctccaatattaacctcagcacagccaaagaaaatcattccattccattgagcggagtcagaaacatgactaggtcacgatcacaaccccgtgtgtgccagggtgaccgagactgggtgactttatggtgtttcaacgtgtgggttttgactgattatattatgggttttccagtcaaaaactcaaagcagtggataaagcacttgcgacctaaaataagcaatggaatgaacaggaaggcgaaaccagagtttaaagcggcaggacaaacaggaaaaaggaagagtgaggcaggaagggtttaaatgcaggctcctcggaggacaagtcgccgccacacccctgtctgccgtcccgccagccgccctcacgcggcgcgggaaaacggtcggcctcgccctgggctcaggttctctccgcccgccaggcagtggggtttttttttgttttttttgagacggagtctcgctcagtcgcccaggctggagtgtagtggcgtgatctcggctcactgcaacctccacctcccgggttcaagcgattctcctgcctcagcctcccgagtagctgagactacaggcacgcgccaccacgcccagctaatttttgtatctttagtagagacgggctttcaccatgttggccaggatggtctcgatgtcttaacgtcgtgatccggccgcctcggcctcccaagtgctgggattacaggcgttagccactgcgcccggccccagccaggcagttttaatcgagcgctcacaaccactgagacgcagtgaagcacccaccataaaatcccaggaggccgaccgccggttcagactttttcttttctttaatccccgtccaagggatccgccctcaccccccaccccagccaccccaattccctattccctccccttggacggcgccggggaaaacaagctgctcgagctttatttcttcggtgcaaccaactcagaatgaattcctccgcccctgcgtgctcagtgagtcggcaccctagcagtgaactgcatttaaaacctcaggaattgagcgaactctcccagtggctctcctcaccgggatccccttccacgcctcctccccgtgccgcgcctcagtccgcactgctcattggccgcgtgccctgccaatccgatgcacgtcggctagggcaaagaccgcgaaaaagcgcgtacacctggctctgggagcgcgcgcctaacgccagccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctc

SEQ ID NO: 37521 - DNA, 56743 bp, Homo sapiens
gtagccgctgccgcctctgcctgggtcccttcggccgtacctctgcgtgggggctgcctccccggctcccggtgcagacaccatggtaagtgctctcagccgggtgcggcccgaacctcacccctcctcggccggcctggcagcgagggaactggccgcgcagccggagcttggctcgggggccctgggcgctcactgccggccacgggagcagcctcactccttgcccgcgcccagtcaggggaggtgggaacgccgcgagtcgtggcgggggcgatcggtgcctttgcttcccaggcgggtttgccgctccacaccgcagcttcctgagctcgggaaggggaggtgcggcggaggcgtggggtcttcccggctctggccggccccaccagtgtgggaggctgagcgccagcggaagggaaggctccgggttcgcgtccccgcgctgcccccgatgcccagcctctcccggagcggtgacaggtgaggagggtgggaagatagcgtgggggtggggcggatggtgacggggagaatccaccagggattggggggttgcgcccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgctggtgatccgcaattacggccccgaggtgtgggaagacatcaagtaagtggccggctaccctggctgtggcccaggtcggcgcccagtgtgggaggccccccgcgcctcgcctggtcctcagcctgctggccgggtcgcgggcgcgcatccttggaggtgcctccgcgcctcgctcccggctcgctgcagctgcgctcccacgctccgggactggaaccaggaggggaggggcggctggggcggggctgcgagggcgagaaccgcggaaaggagcccctaggggtcaccacggcttcccgacccggcctgagcgtgggaacgcgctgccggcgctcccaggctcagcaggccgggcagctcccacgcgtgcagagccccgagggaccacacgggcctccgcgaggttcctgcgcccggaggccttagaaacaaacggaagactttggctcctttatgatttacacacctggcgtaagttaggcctttttggtatgctgaaacacgcgggagattatttcttgagcaacagtgaattaagcgcatttattcatttttaaataaagtgaaaattggaagttttttgttttccccaaatcccactgcccaccccccccgccccaacccctatcccccgtttttttctactgtgttgaagacttaacagttctaggaggcattctactttcagtcctggagctttgagcccagtactggggatgtgaacggaaataccacacccacctgagagtttaaacctgttggaatgactgatgggtcagcatgtctgcaggcaggttgactatttcactctaataaagttgtctctcctttttcctctcactctcaaaaaatttgcatttaacttatggtacagctgaccaccaccaactagctactccaaaaccctatttatggattttcatattagagcaacagtcagactatcacattgtaacaaaggtggaaggaagggtttcctgggtgggcagatgggaatacactgttattattcactctgatttcctgtacttagtgatttcattttgttgtctcaggtaggtgaggcttccatgctgtttttccctaagcacattacaattattagcaatcaattctaacaggccttattatgcagttacatgatggtgatttctcataacgatctgtttccatagaaatgaccagggttatatattaagcacgaaaatgtaacttttctttcccctggatctgtatcactgagcgtttctttcatgtttcagaaaccatttgtattatccacagggcatattacctacatattataaacagaagccgagatttggcaagtatgtggttgaatccaatgagaacataggcaccaaaagttactttaggatttgaattttctggccatcttaataccattataatttttattttgcttagtagacagatatcaacaaggcagacatcaaaaaaagattgttaacagtataacttaactaccgaattatttttaagccacttcctttgtaaatttataaatgctatatatatatatattctccatatgatgcttttgcatctgtaagatagaaattcccaaatttgctggtagatatgctatgacaatgaatatgcttagaatttttagagcagaataaaagatggctattatgattaaacagtcattatgtaatttaaccagatttagattgtatatcctagccattatcagtttagatcactgttaaatacagagatgaaaaataatactttatagagtaatgtatcagacattttaaaaagttaaaattatccagagatttgtttatattgcttatattttcccagaggaagtccaaatatgtaaagattcaattgacgagaatttaactctgcaaaatcaagctgagaatattgttccattctactttaaaaaattatttattaacttactaatttatctttaagtagcttccaacagtattcataatttgtctaaaggataaaaattccaatcatccacaacacaatttttctggtaaaaatgaaacaagttatattggtcttttcttaaataaaattgcctcaaggttatgcccctgcaagggaaaaagtgttagtcacactggtgttggtaatccaggtgttagtgttgattctttatttgtctaagcatcttttggtggaccccagctgatcttgggtgtggtttagtgtctgggctagagaacatggttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcattggtccaagatgctttcagttttaacttttataagaaattgaatataagaggaaaaacatttttttttgtctcagtaagtaccaaactcttattttttcttttggtctttgagaaactatctaaattgatgtttatacaaatttacattatacttttttgcttcactaggaaatggccatccatccttcatgagaaaggatgggaaaagatgccaaacatttaatgacaaataaaaccctaagtaacagattccagacagcagacagaaaattctaagtggataagggccaaaaatgcttcattgtaaactcagtatccacttacactcttaccaacaatataaccatttcacaaaagctttgaattcctcttaagaagaagaaaaattgtctagaccaagggccagcaaactttctcttaaagggccagatagtaaatgttttaggtgttacaggccaaggtaaaactgaggatattatgtaggaatcaatataactattaaaaatataaccacttaaaaatattaaaaccattgttagctcttggaccaggaaaacgcaaacaaacaaccaaaccagacaaagtgggctacatgtgatccatgggctatagtttgatgacctctgatttagaccataacaaatgtgaaaaagcaaaagagacctctgaatccatttcaaagttttttttgttgatttcatttcaatattcaaatagtccttttaagaggctatgatttctaagtaatgacaaaaaaattatcagggtagaaaataaataaagttaggagtgatacatcctagaaaagcacctaaatacttgatttcccatctctgttatccttccatcagccctgactaaactcatcattgcgtcaaattactgggtttaattttagattttttctctgctttctttccatattttttctgggtagcagcggagggaagcagttagagacaggtcttgctgtgtgcccaagctggtctcaaactcctgtcatcaagtgatcctcttgactcggcctcccaaagtattggattatatgcaccaccacacccagcccaactttagattttttaacctcactgaaacatacaaattaggaagatagatccaaaacactgaaaaatcccaaatgattaaaagtctgtaaagaaagtacactgtcctgacttaaataaatcagataaaacgtttatctttaatgagtatagtcaagtgttttaggcactgaggatagaaaagcaatgatgtaatccttaccttcaaaaaaaaaattctagagatttcatgatattttagtcttattattttgtttttattttcctgcctataactcaaatacggtaaccttttgtctgttggatagcatatacttccagttttgaaattaatgtgtcttgttaaatttgctaatcacaaattaatcattatggttcaaataaggaaacactttgctataaactagttatgggactttccaagttgcctaaactttccaatcctccattgcatagaggaaaaaataatacttcacagagctgatgtaatgcattgaataatgtctgcaaaatgcttaacatagttcttgacaatagcttaataaatgatgatttttttttattttactctagaatcagagtttttaaactttccgttccccaatttacttgaaagatattaagccctcctttaaaaaatattattgcagtctatattctatcagtctaaattttttttatcactctaggataagtaatcatcatcatcatcatttttcatcattttgttttgaaatgcaacaaatgctcttaatatccattgtatcaaagcaaattaaaacaaacaaaagagcacatcaccatgttttgccgtgtttattcagattttcatatttttgaaggtgtgatttaaacttctatacctttctgtagatctgcttaagtagtaatgagcctatgtatgttttaaagtagtaaggatactttatattataaagcaatttcaaatttccaaagttttgttctctctataattttggttgactgctacaacatccatttgaaataggaaaggactttacagctcaatttttttaataacaaagttggttttccaagaggttaattcccatatgtaattacttactgtcccagagaattacatataggaaactgaaaagtcagaacttcagcccttgttcttctgttgccaggtttaatgcttcttttaagatataactgtgaaataggaactaatgtagtatacatacaaaaatgaaaccacatttattttcttacccagaaacttcctcagtacaaataaacacattaatatacagactaaggaaacaagtaaaccagatcattgttaggatcaggatccttttctgtagaaagatctgccagttagcctgaaatacagaggaaggcgttgcattgtattgtgtgttggctgttaagcttactaatgtttgaagttatcttttgcagctggaactggatgcccaagtgtatactccatcacatacctgctattgagctctttgcatagggctcttccagaacctggaccatgtctgtgagcagcatggcaggcacctaggtgataaggcgggtcatcacatgatctcagggagtttgtgggtgtttcttttgagttttattttggttctgatgatctgaggtatcccccagaaatcaagctgggtcttggagtctttattttccttgcattctgtgatttttgagaattaaaaaaaaaatcagaggagtacatcacttaatttggcgtgtcggaaggatctttgcacattacggtgagcatcagaaatcagaaaatctgtattctcactcttaatgtacccagatctagttttggcaaacatttactaagcattgttatgatttgcaagaacaaagtcctttctactttcttgcctttctccagaataaggggctctagcaaatgtttctctttaatgtgttggaaaactatagttatgggttgatgctctgcagacatcaataggaaaacacacttaaggaaatgaatgctataaagaaatctaactggctagatccgagggtgacagctcagcagacgtgagtacttgcagctttttcattctctcctttgcctccttgttcgttaaagaggaaatggtgggagaaaaaatgtctttattgtttatgtctagcaaaatgaagcatctttttctgtgtcaaactatatcaaaagatagtgaagttaaagtggattttattccaggtaaaagtagacattctgaagtatttattggacctcctcgttactgtggctttggttctgttgcatattctggtctacttccccttcattgttgaatcatgaaatatgaaattgttaaatttattgaaattctttgtggtcaatcttcagataacccaaacatggaaacctttcactcaacttgtcctacatacccttagcattccagccccatgggcctgtttttagtttctcagccataccgagccttaaatgtgtccgtttaacacctgtgcttgctatggtctccttttcttcaccctcccaaccctcctgtaaatgtaaacacctctcagctttgagatgtcaaagcaaatgtcacttcttaagggaaccttctctcacatccaaacttttccctttccttcatagtgctgtaatgcaagagtttgtacttagtatttgtactactgattaatgtctatcctccatgacaatagcctccataactctttctagagtgctctctctctccctctctctatgtattcaataaaatatcaggctctctttctgtaataaaaatatggatgtttatatgtgaatgaagtatctttcacctttttcatttccaaagaatagagcacacacatatttttatcaaagattcttctctgcaaccagaatttatgtcagcatggtgacatattcaactactatttaaatataagctgttttcaaatagacatttctttttctccaagatttattgagatataattgacaaataaaagttatatatatttaaggtgcacaacttcatgttttgatgtacatatacattgtgaaataatcactgtaatcaagccaattgccatattcatcacctcacataggcaccctctttttttgtagtgagaacacttaagacctcccctcttaacaaatttcaagtattcattatagtattgttaactgtaattgttcattgtaattgttaatagtgacattgctgtgccaaataaacatttcttatatcagcaaaggcagaagatagagcaatatagcaatacataatagcaattccttttggaagtgtcagagttcttttatgttttctcatgtcatgtggatgtattggaaggactaagaactctattgttagaatgacaatttcatatgtcaaaagacaattactagattggattcaggacatgattgaatcctttagcaagtttctaaaaggcagggatgtgtggtgctgtttaaagtcagtgtcatagactgtaactcagtgtttagaatactgaaattaaatttgaaatccagctgagctctcaccatgtcatgctatttcgaatgtaatatgtcacgtatattaaacacataccatatggttctgcagtcacagtcctagatgctttatactcattatctcagttaatcctcatcaccaccacagaaaatagattccttcattatcctcattttgcaaatgagagaatagaggcgtaaaagaaagcctgcctcaaacactcagctattaattattagagctgggatttgaacacagataaagttgtaattatcatgttatgtgttttcctccaaagagaaagacctataaccttcttctttccaaagacaaccaatttagcaaggacatgtgccatgtttatgtgtattagtactgcctgctgctttttcttttttcttggaatgttcaagcatgcgtacaggtgatttttgacaacaatatttttaaaggcgaattgacatgaagcatatacacaagtgtctaagtaaattcatttgtctgttaaagctgctgaaaatggctcagcagctcaaatgaagatttgtaagttttgtggatatgttttcaaaattggagaaattaccattaagggtctcttgtgactcaaaattggagaaattaccattaagggtctcttcctgacaattgcatgtcaggaagaaacatgcaattatgtatcaagactgttgttgtttcccctaaaactaaggtatgggtgtcactcaggagagtatttattgttactgtttacagtgattggatgagtgagtgaacacattgacatgaaaggactgacctttactaactaaaagggggttcaggcaggaagtcgttactggatttaaagggcctgtctctccacttggcagctccctcaagccagagtctctcctttggggttcaggcttactgagaatcattagattaggccattgaaaacttagaggctattcatgctccacagccacttagaaaaaagcaatataaagttttacttttttagatgttatatatagttactatccacagtttatagtgggagattttagttttaataatggttggggacaatgcaacattatggtaccaattcagctcactacaatggaccattctaggatttattatcaaaacgacacctacgtactgttttttaatacagcatgtgttctgataatgttgtttatgggatcaatagtatcttggagctgtcattggtcagtttgattgtttgatcctgattgaccttttctgcccaagagcagaccttgtgttgagattatgttttcaacatgcctgtgttcaggctctcccatttcaaaatactccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataataaaaaatattctttagtttgaaagcaaatgatggacttttgttagtaatgtttgattacttgtttgttttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccaacttaccaaacaccaccactataaaaataccaactacctctttgtgaaaaggtaattagtataaataaaggatctgcttaaattccaacaaataagagtaagtaggaagttgattgctactgggaaactatttcacttatacgtattcaacttctaaacagttactgtggctacagatacaaagaatgtgattatttctgattttgttgccaggtgagaattcgatctttatttttaaagcccttaggggcaacagagcttgtttgtttcttggctattttagtttgtaaattctatcagcaaatctgcatactaagtgcaccttaattatttgattctgactaaaaatgactaagattttgttgtcattcttcccttctcttcttccacttgccatttcctctttctcctttttcccttcttccttcatcttctccaactactataacttaccagttagaggaagtatcaggcattaagtgtgcaagaagtactaccctgagatttttgcataggttaattctgctaaccaacacaatgaccggaggtaactgctgctgttagcctgttttacagatgaggaaatgaaacaccaagagttgaatctgcccaaactgcacatgggattggcttagttgtttattttccatactgtgtgaggaaagactttgacttatgacatagatgaaatcaagggagtttctctttatctaggtttacttgttagccaatgaaagtgcttttaaacttgaacctctctaaatatttattattgtctgctgacctctttcattgagtaattcactgaatagaaaaatttaacgcttaagccaagcagagtcattgggtatgtaaatatggcaagtcatagtatttgaaaatagtgaaagactatgttcacttgggatttggtaggacttttaaaaataaaaataatagtagtaagcagcaacagactgtaatacaaactaggaggcatgaagattgtagtgctgttggttattatttgatagatgagcactcttgaacacagtttaatccaatttacttagagtttatatgatattttttgtcatctaagaagcattgaaaaaaatgacagtatgtccaaaattttcagaaaaatcttaaattgtggttctcagggaaacctgtggtttttctcacatgtaaaataagtacaatttaaataataaggtaattgcataatttccctattatgtaattatataattacataataataatgtaacaatgtatacataatgcaacaatttaaacaaaattggagctcaaaaaataattctgaaagaatgaatgagtctataaaatttggtgaatgtacttggctgaatttggataatttaagcccatataaattctacttgtcacaaaaataaattttaaattactagaagtgttattcttgcctttgctcttgaggaaagaacttaaaagttatgggatagcaaagtgggagatgcagaattatgagataatattacttgaattatgtaaattgtttatgtaatctgaatattagcttacttcctaacttttcttaaatttactggtcgccctctgtgacttcaggtagcagataaaaaaacagccctaaagctaaggagagaaggaagcctgcagtgtgggaagggaagccattaaaactttcctcaaagaacagtggcagctatattttgcagagtgctgggaaatggttattatcacatctctgtgctttctggaggttaaaacatttgacagcatgaagtccgattatatataaatttacctaaaagttagaagaaaagttgtattgagaattgagagacaacagagaaggcttggttgattcaaaatttctactagcttcaaaggccatattatctgaaattaattctcttagttattattccttcattgtatattctccatctcagtttagtgtattaaactgcttcatactaaagagtttgcgatacctccaattaacttttgcagtatttccaattagcttttcccctgaaaggaaagaagatgaagaataggctagagaaggaaaggaagtggccccagaaaggttaggtataaggtggtaaggatggaggtttcctgctcaagtccttgctccggcgtcactgtccccatgaagcctaccatgaacacctatgtatattatcctcatatgtatactgcatccagccccttcctcttgcatttccactctcatgtctttatccagagctacctcttcctgtagtatctattgcttcataacatattatatcattttgttatatatcatgtttattgcttattacttgtatctgtcagctaaaatataagctttatgaggacagggatctttacctcttttgttcattgatatattaaaagtgcttagaaaagtgcttggacataataggcatccaaatatttgtggtaaaactgttccataagaaaaaaagaaaaagaaaaagggtagccccacattcccaaagatgtaaatagagtcctaagtactttgaataattcaaaggaattcagagtgaaatttttaaaagaagattattatttccttccatgtactactgtttaatttctatttcagtccccactggggagcattgacactggtcatttcaggaagtaaagctttgatgataagggagcttattttaataaagagagagaaaggaaaggaccaatgcattgacccatggttagggggtttctgaggaaatggctgttcccctgttttatgcagagggactgtggattctgcttgtaccttgtttatttatgggttactagagattggtgagtgtttcaaataaacagagtttattacagaaatttatgtgatttgatttattccaattggaagaaacagaatggtgaaacatgaataaatttctacttattgtatctttaattagaatattctgtcagagtctccaaaattttaatctatagatcagtgttgtttcaaaataaaatgttaatagcaaaatgacaaaacataaggtatccatatccgtcaaactatttatcccattcctaagaatttgttctgtttttacatagaagtgtaagaagctataaagatattcataacattttttatacttgtggaaaaaataaaaacatctaactacctaccaagacttcaatatgtctacaatgcaattttatgcagccatggtatagaagtataattatgatatgaaaagatatccatcaaatattcactcaaatgggttttaaagcagtatgttctatatataagtatattcaagcatgaacaacttgaaaattataatagcagtgattatctcaggatagtggaggcttattttctctttttagtttttcctttcctgtactttatatatatttttacaattagaaattagaatgcagaaaatatatagtagcatttatcagaggataagacaatgtttgtatattacgttttcataattttttgatatctcactgacttttggtattaaaaagacttgaggtcttcgaagagttgtgttgcttttgtttaacagctgtttatgtttggaaaaagggagaagaatttaatattttatgtacagtgctataattgtttgagtagacatggggagtgctatattcactgggaatatgtatagtactttaactgcttagaatatacttttgtacactttatctctttactgttgtgaaaggtgaattatctgttgcttccacttcagaaaagagaggttttgtttgtttgtttgttcgcttgtttgttagctgagtcaggatctggctctgttgcccaggctgaaatgcagtggcaagatcacgcctcactgaggcctcaactcccgaggctcaagcaatattctcccacctcagcctcccaagtagctgggactacagacttgcgccaccacacctgcctaattttttttttatttctaggagagaagaggtcttggtatgtcgcccaggctgttctcaaattcctgagctcaacggatcctcccacctgggcttcccaaagtgctgggataacaggcatgagccaacctgcccagccagaaaagagagattttaatgcttatgtgctttatgtgatttgctccggttcatttagctggtaaagcctgggctctgaaatgcagatctctgtgcttacagaaaacatgcttttaaaaaaaaagttatgaataaatgcaggcaaataaattataagctctgaaggacagaggatgtttttaagactatctgcatactaaggtatggatgtaagacataccaccatttggaatttttcccttgagcatacacagatatagtcatgagtggcagctgtgatagcacagcttctgaaggagagaaagcaactaaggactgccttgaaaatatttaaggagttatttgagctgctgtgttgcaagttcgcctaattagagtggctactttcctttgtattctcttggcaatgtacagggattccgatgaattggattgagagtaagaggttgacatccaagctccatgtatttttgtgaagttaacattggcaatgatatctggaacttagttcttttctacagttggccatgtgggtttttttatttacatacatttatgaggtacatgtgcaatttgttacatgcgtagtaggtggcagtgttttaaacaatggatttcacctctcctttgaatgcttgtttgagaaaagtaattcaaatcctatctaaataaatacatttatataatcatgacaacttttaaaaacaattataattttctttcactagtactgtgtatgttttgagctactgtgtttaataagctaaggatatatttgaagattttatcagtccacttggcatctcaaacttaatatgtttaaaaacatctcaaacttaatatgttgaaaacatagctcttgaccttgaccccttgtccgcctccaacaagtctttcccaattcagctactggtgacaacatccttttagttgcttagaccaaaaacctcagtgtcctccttgagtcctctcttttcacaccctgtgtccaatccatagcaaatcatgctgaatttacctttagaatatatatgagtttgaggcatttcttacctgctccacgggttcacgccattctcctgcctcagcctcccgagtagctgggactacaggcacccgccaccacgccaggctaattttttgtatttttagcagagagacggtttcaccgtgttagccaggatggtcttgatctcctgacctcgtgatctgtcagtccccgcctcccaaagtgctgggattacaggcatgagccaccgcgcccagcccaccaacacttcttacctgaatgttggcagcagcctcctaactggtctccctcctctgtcttgtacccctttagtctattttcaatgcagtagccaggtgaatccctttaacctagagcagtttatatcaccactcatgtcacaagtgctcaagcccttcacctctttcaagtaaatggcagttatcccaacgtccaaccaggccaagcactgtagcctcatgttacctctcctacccgttccctgatagctacttttccccctcctctgttccagccacattggcctctgctgtcctctgacaccccaggcatgctcctgccttgccctttgcacttgctcttccctctgcccagaacacaatctctctaaattgctcgtggcttactctcggagctccttcagactttcttcaaatgccagcttctcagtgaggccttcctggctgctgtccttgagctctccactgctctactctgctttatttttctccaaagtataatacttaccattatatgttatttattaattttatgttgtgtctgttttcccagaatatatgtattgcaagaagtcagggatttttgtctgttttactaaagattgtacccctagtacccagaacaatgtctggcacctaatagggactcaacaaaacttgctaaacatctattaacccaaaagttatttaatttattatatttaatggcaggtattgtattgagcagtagagtactatgtactgttaatcttgctaaaatatacttaaatatatcattttaatttagggagggggatatgacatcatttctgctctctcactagaattttaggtacatgatgatgtttaaacaaatttgcccaaaaaaaccaaattctatttcagagataaagccattgtttatacaattattatacttatagtagctatttttttaacttcaacttttctcttctgtctttcttgtttttgttttccagaaaagaggcacagttagatgaagaaggacagtttcttgtcagaataatatatgatgactccaaaacttatgatttggttgctgctgcaagcaaagtcctcagtaagttgaatgcaactttccttctttggccaagttacacgtagaagctcacagaatgcatggttcaagatcacaacgcagggttacagaagtggtgcagagcatttgtacaacctgcatagttgtgtggtgggcatccacatatcatgttaggctcaggctatgccaagtcttatttttccttttgcaaattctttagagaatagaaaagagtaaatgtgctcttcttgttgttttttgagacagggtctggctctgtcacccaggctgcactgcagtagtggcccaactccggctcactgcatcctctgcctgccaggctcaagtgatcctcccatctcagcctcccaagtaactgggactacaggcacgcaccaccacgcccagctaattttttgtatctttggtagagacgaggtttcatcatgttgtccaggttggtcttgaactcctgagctcaagtgatctacctggctcagcctccgaaagtgctgtgattgcaggtgtgagcctccacgccaggcccagtcctttgtctcccccaacagaaagccatgtattcaggaaggaaagagaattattgatacttaatgtaacaacatcagttgtggtgtcaagaaaacggtagttattcaagtataatatgtgtttctccaaatctcttttgtagtcacaagttatattaactattggtaaaagaaacatgaaactgagatctaccacagataaatatctttctgaagaaggcaaagttttaaaaatttcatggagaagaagttgttctcaaagtagtatctattattcccacagtgcttaatttttaactgggctatagtttggatacaatagaatgaagcttttagctttgccacatataactaggaaagcaaacactatctatagtagaataaaaattgttttaaaagattggtaaatgtttaatattaacaagaaaaatatctagcctccagcaatcaaaattgaaacaaacatgaaataactttttttattatcaatttggcagtcttaaaaatggaaatatctagtgtaatgatggagtacagttaatgggaaatcacatacattttaaatgtgatggtagttaagacaacttttttgagaacaattttgcctcatgaaagccttttaaaaaaatattaaaaccttcagtaatttttcctaaataaattattagatctctttccattaagatttatgtatgtgttttcatgtcagagttccatatattatcaaaaactgaaaaaaagcctacattttcaataagaagggattggttaaataaattattgcatccatatgttgaataagatagcaattaaaactgatacacagcactttgagaggccgaggtgggtggatcacttgaggccaagagttcgagaccatcctggccaacatggtgaaaccccctctctactaaaaatacaaaaattatccaggtgtggtggtgggttcctgtggtcccagctactcaggaggctgaggcaggagaatggcctgaacccgggaggtggaggttgcagcgagccgagatcctaccagtgcactacagcctgggcgacaaagtgagactctgtctcaaaaaactaaaaaaaatgtgatacagaaaatttaagttttaggaaatattaatgattgtttattaagaaaaaagcaggacaccagggtacatgttatatgtaatcaagttattaaatatacatatttatataaagacttttgtatcaaaatattgtcatgtgcattcttgatgattttaaaaatctgtgttttttggaaaaaagaagtagtatatcaaatatatgctttaaaatggccaaaattaagtacagggtgagtatctcttgtctaaaactcttgagaccagaagtgtttaggctttcagattttttttggattttggaatacttgcatatccataagaagatatcttgaggatgggattcaagtcgaaacataaaattcacttatgtttcatgtacaccttatagacataggctgaaggcaattttgcacaatattttaaatgattttctgcatgaaacaacattttgactgcaatccattacacgagttcaggtgtagaattttccacttgtagtgtcacgttggtgaccaaaaagtttcaggttcttgagtatttagaatttcagattttcagattaggtatgctccacttataatttgtaatagaagctgaaaaactggttgctttgcttgtaaatgcaaatgtacaccattaacatgtttatacgttgtcttctctgatttcattgtattgtcctggcgggatttttttcatatgatctatgcttgccatgcacaaaaattgaagacattttacattacttaataaacacttatcttcattttttctattaacaatatttcacctattatatgctttttttcccctcttgaatttgtaaaatagatctcaatgctggagaaatcctccaaatgtttgggaagatgtttttcgtcttttgccaagaatctggttatgatacaatcttgcgtgtcctgggctctaatgtcagagaatttctacaggtaagcaatttgaggtcctatagttaaaagttctgtgtttataactctcaaatatagactctagaatacttttgttcactcagctgtacaagagtgtcttgcttctgaaatggaatcgtagtcacctttttctaattcacataaaatcatcgttattggagcgtctcgaatacattttagcattatattttttctttaacttctggttgctgatactgaatatgcaagttgtaaattaatgttccctgaagaactccaggtggtcttttgtgatctgttcaactgccctttttttggggtaatggctctatatcctagtgattgtggttttatgtgttagacatttaatatggccttattttctatttacaaaacattcctagtttgtagatataatcgagcaatgtatcagtatttatgaagttctacctggagctcaatgtttaggaaaaagtagtagggttttcaggtgttctgtcaccaaaacatacttaagatccattatcattagttaaatattaattaatctactgtacgagggaaaataggaaacagtccaaagtcagtttcaggtgaaaaagttaaataatgcaatcacaggcctttgtcttacattcttgttaaaattaccttaaaagattgtactagtaaattacacattagatgagagactatttctggattgactatactattttaagcattgacatttgtgagaccctcttcttgaaatgtgttaacattgaaaattatatagttgtttgcaaaggatatttctaaactggctgctttcagcagccagatcttgctggaaaatgatgtcagtgcaatactagctgaaccgaagcccagttttgagggaatgtaaactactttcaatccagctgcattattgatttaacagccaaaataagaactttagtgtttaatcaaaatgtctgttgtttacatagtgacatttttcttataaacttaaaacagcattaaatcaagttggaaactggtttgcaatctcctgccatggatttactaaactactggtgtcaaaaaaagctgccacttccaaatgaagtagctgccaagagatatttaaataaaattgaacaggcagcatttaatgggattattttaaatggattaaaatttgatacttaaatgttttgggggattttgggtttttgaatacatatttcactttttagtacttttgttggccactatcaacttatagcaaagtttcaactttcagttgttctgacttataactctctctctcaatgcccatgtttacataacaaaacaaagattcaagtggttttattaattccttttttttttttttaacctctactcattgtgaccatctgctaagcttgttatggcacagtaagagagcaagcggccttttaggtgtgtttctctgtattccagagctgctttatccaataggacagccactagtgcatgaggctactcagcatttaaaatgagatgtgcaaactggggagtggctcacacctgtagtcccagctacttggaggctgagatgggaggatcacttgagcctgggagatggaggctgcagtgagtgagctgtgatcacatcactgcactccagcctgggtgacagagtgagaccctgtctctacatacatacatacatgtgtacatacatacatacacacaacaaagtgcaatgtgctgcaagtgtaaaatatacaccagatgtcaaagacagtacaaaaagaataaaagatggctcattcacaattttatattgattgatttcatgttaaaatgttaatattttggatatatttggttatataaaatgtagttaacatagctttaaattatacacaattttattttatttctctttcaacgtgagagtgaaaaatgaagaaactagaaagttagaatactgtagttttcatcaatattttacattatgattcagttcttttattttctcctggttttgaaattatacattttaagggcaaattgaatatgttaaaatactgcttttctaaaaagtagatatttatgttatcattaggctgattacacagaaattaaatggactttttctgtgtgactataaaacaaaatcattaactttcatacattgttttaacatgccagcacacatatattgacatttttattacgtaaattagtaaaatattctttatggtgacttcaactcttcactaaaaatttaaagactttctttctgtttcagtcctggttttaatcagtcacagcatctttagattctatttcccaaatactgagctttgggaattctgccacttttctctatttccccccacacttctttgggagagtctaccattatctagaggttgaatggattccctgcttctcttcatgactcctccaatctcttctccatcctataactctagtgctttttctgaaatgcaaatgtctctcgtcgtatcgttttcttgcttaaactctggagtaattttttattgctcactggaaactgtcaaaatatttaaaacaattgaaacctacatcctttctgcatctttcctctccctctcccccagtccagccaaacttaacctctttaagaaccttgtatttatcttgttcccgctatcctctcagcttttccactgctcttctctttgcctggagcatgtttccagcactttccccatagataaattctattaattctgcaggtaaaattacttctctgggaagacgccactcctctctccaagctctgccctatcctagtcacggtaactaacctctctcttattttcataggacactctatttccccagccacagtagttttcatactgcattatcattcccatttgatggactggaatgtaaacttcaggaagccagagatcatgtataatctcttaatgtttgtaccttcacagatgcaatctgtatatctgagaataaatgaatatcttttttaaaaaagtgaatatttgttgtttgtgcaaaagcagaaaacacacaataggaagcaaacacaccaatagatcaagctgaattatttgcctcaggataacccatttcgagtgagatcctgtaattttttttacggatgaatcatagattgaaatataaaagaagagacatacactagaccaatttccttttcaggtgaacatcctaaattactgtttattatttaatttacagggtacattgcttgtatctgttgacacttttaaaatggtcgttctgacatttccattttaagcttttagggaacactaaaatagctactgaaatcataacatgggagactatttgattatgccttagctgagcaactctgactcactcatcatagcaagcagaatttccttggaagttgcctgtccacagcctctcagttagatacattattaagaataggtctgtcttatatatgtatatacataccataccattgtttttacttttcttgaaataatgaaagaaaatttctaagtactagacacagcatataataggcaattaatgaaacagtctttaaataatagaattaattaattctgaagtatatgtgtctttataattatttggtccagcctgttttatcaggataatacctcttttgcttaaattttttattcgaggatactgtatagataatatctgtagcttagctccagaaaaatatttgttttctcacatggaggttatcatttccattcacagttgacttaacgaatactaacatatctttccccttgaaaggctttggtgccaatatccaattcatgaccctgcttatgcagtctctcctgtgcttacaaattcaagtttaaaaaatttgcattatgcgtattttaagccacactgagactttaacaaaaaaatagctagaagtcctaaatggataaataaaatataatgggatatatttaggataaataaaatttaggataaataatatttaggatatatttacgataaataaaatttatcctaaatggataaataaaatataaaatttaatggataataaaatataagaaatatttttagagaaaactttgtagaaatactcctcttctctaggcatttcacagtttagaattgattttttcttaaatcaccagtgaaagcatcaacttgtgggctgatgaaaaaagtaataatctttggcatttattctttggttgatttaataattgaaaatataatgtatcaaaaagagaaaaagaagacatttttaaaatttgatttttggatcttatatattttacctgggtatattgttttaaagacaagaccatatttcagtaagaattttgtctagtttttccacttttttattcataaattgacaataaaatgtgtggttccatgctattgctatagtcaatgtctttttttgcgttttttaatgttttattattattattattattgagacggagtcttgctctgtcgcccaggctggagtgcagtggcgcagtctcggctcactgcaaactccgcctcccgggttcacgccattctactgcctcagccgcccgagtagctgggactacaggcgcccgccaccacacccagctgatttctttttcttttattttgtattttttagtagagagggggtttcaccgtgttagccagaatggtctcgatctcctgacctcgtgatccgcccgcctcggcctcccaaagtgctgggattacaggcatgggccagagcgcctggctgctatagtcaatttctatctgaagcttctagtgtactgatgaaaagactgcaaagaatacatgggatttgaaagcttcataagaaaatagctgataaggaatgttcagtttaatgttatttctaccttaatccacgctcacctctactctctaatgtcctattgcattatggcacattctattttccctaaattactgcaacagtctctcccatctcacatgcatttctgtagtatgattttgcctcttccttgcgggaggtaaaattctcttttccttgaatctgggttggctttagtgactatttaaccaatcgaatggggcagaagtgagatatttaaacttcctaggctagagtacaggaagtcttggtttccttcagggtatcttggaacagttgctgttgcgatggtacctctagaaacccagacacatgaaatgagaagcacaagccacatggagaggccacgtgtagactggcagatagcagttctagctgggctctcagcaaagagctggaaataactaccagccatttgattgatccatcttggaaaaccagcctgctccggcattctgataatttcagcccagtttccatctgattccgtcccaagggtagaactttctaatttagccagacaacccacagaaccatgaaaaataacaaataaattattaaagttgtttgacatacagctatggataactagaccactactctgtgcattatttttccctttatattttatgtctgtgttaatatgtgtgtatatgcttgtacaatgagtcaagagctttgagaaagctgtatttgataagataatctattacccctgggaataggagccatgtcagtcccaaacagggctaccaattcaatttcgatggtattacattattattacattatattgtttttacctcccctacaaatttacagagttaaaatgcaattaaaatgagcagcgaaggctgccaggttgactatgaaaatatacgtgggcaaatgcaattttagagaacagttaggatttaaattatgacctaatttaaattagaactcaggtgaatagttagatcagcgttctttcattatttgctggagacactggcttcttcaactaaccttgatatgttgacagtttcagtcattcactcaactcagatatatttgagtttatcaactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacaacgccaatttctataatccaataataaaaatagttttattttttaaaaacttatgaaggaagataagaagtattccagaattgtaaggcttttcagtttgaataactggtatatattttcataatttttcaaaatattgattaattgttacatgtagtattatatagactggatcttttttaacatgagtttaaaagcaatagaataagagaaatattttaactgtttttctttaattaaaatatttccttggagaggatggtaatgataaattgatatagctttaacgctatttccatttaaataattttagtgactctggtacagtttctttttaaatagagattttcaatgtttcttttagaaaagaatctctatatcttttcagttgaaaagctatttaattctcaagaagcagctccaggaagaaaaggcaggaaaagtattatgaaagcattcacttcctactccaatctcatgctatttactttggtgtttctcatcatctagggtttgatgttccattttacttaggtcgactttgtttaaatgttttatcttcaaattccaaaatgacttttttcttataaaacttaacaaaatattttttaaattacatgactctcattaaagaatgttggtgttggtcctatttttcagaggtgtgagggatagaaagaaaggaaatactatacctcatcctccttcattgaaaaacaaaaagaggtttgcaatgactggttttaaagatttcttgcagatctaaactgcagtaatattctcaacacagacaactcccttctccccatccactaaaacaaggattcttggatactgaaaatgtttttctttaaaacgttcaaggcaaggtcttacccatttctgtggatcctttaaaaaatttaattagatgtccttgaaacaggaaaatcaggtagttgacttctggggactttgcccctgtaattatgtaagaacttatttttggcatgcatattacaaaaagaaaatgtgcatttattttgaaacatcccaagatctttaaaaatgtgacactttattactcaaaggaatgataaattgtcttttgttttctaaatctgtgaagtgtactatgtctgaaattccagtagagtaccccagaataccagaactaatttttcttttataaatgataaatgcaaggtgataaaataaactagactgacagggagcagaattcctgagtagaaaaaccacattcatttgcttgtagaaaaacaataaaatgatattagaacattaagaaatgaaattattaaattaaaacctttaggtatctcaagatatcaaaatagatgaatggacctactctctatatttttcctgttttttgattttatgaagcctagaagaatgaatcaaagcatatttcagatttacatcattgtttcctgggaatctacttgtgctgcaatgtaagagtttacattttttcagtgtcttttttactttcatacatatggacatacttctttgcaattggccacacagctctttactttctgtaagtgcttctgtgggtatatttagaaataacacagaatatcagttttgatatgaaactcttattccccagaatacattgttagagcaatgtggatgaactatcatctttgtttagatagcattatcaaatgtagaaagggttttctcttggccattgtaagaatctttttgtagcaaaaaaaaaaaattgtagcctgtatatgaggatgacacatttattagcaatataagtgtacttaaatgaaaataacttttaatcattaatctcatttcttgtaatagtctggctgtggtaattactttaaattttgaaagagtaaagccaagtaaggaaggttgtaactcaagaaatcccaagagtattttttatattagatactatctaaagaaaatcaatattacattaagtggtgttcaatcttttatgattcaggagagcactttacttgttcaattaactaatagtaaattcaataacacagtaaatctctggagagttggttactgcaaaaagacagaaaaggtgaacattctcatttggtgtttttggtatcctttggtgagggtgcagtgcctatctttagtgactcaggaagtactgacttggatgattgtgtccactctctgacttgccccagcataagtggtgccagtgacataagtggtgcaagtcgttattgccttatgccatctgcttgagtgaaagtagaaatgttttaataatccagtaaaaaagatgagtatgaaaatgatataagcacattggtacattgatttatgaaatatgtaagcattctgtatagaaaaaatattaaaatgcctttttgaagttattgtttggttcaatttccttttttttttttttttttttgaggcagaatctcactgtgtcgcccaggctggagtgcagtggtgagatctgggctcactgcaacctccacctcctgggttcaagcgattctcatgcctcagcctcccaagtagctgggactacaggcatgccccaccacgcctggctaatttttgtattttctttctttcttttttttttttttttttttttttttgagatggagtctcactctgtcgcccaggctggagtgcagtggcgagatttcggctcactgcaagctccacctcccgggttcatgccattctcctgcctcagcctcctgagtggctgggattacaggcacccaccgccacaccctgctaatttctttttttttctcttagtagagacggggtttcaccgtgttagccaggatggtcttgatctcctgaccttgtgatccgcccgccttggcctcccaaagtgctgggattacaggtgtgaggcaccgcgcctggccaatttttgtattttcagtagatgtggggtttcaccatgttggccaggctggttctcgaactcctgacctcaagtaatctgcctgcctccgcctcccaaagtgctgggattacaggtgtgagagcacgcctggcctcaatttcttttttaagtgagccaacaacacagtacctgggcctgactctattagaaacattttctaaatgcagccacaagctcaattttgactttgtgagaaatgcagataaaaataaaactctctcagtgattttttttttctcacccgattttctttcacaaaatgtttcacaacataagtagaagtataaggggtctgagagggctatgaagcagttctcaggtcgtcccttctaagggaagagtcctaatgagaatgattcatcattggaagaacctctcatactattcaaccaagtaaaacagttttaggactccggggtttgtaggttatatatacctcttcaatacttagtggctgccatattggattacttttacatggcaatagcagcctctagaggcaatccggatgaactgatgtttttgctaagaattagcttgactccatcaggtataattgtggggaaggaaacagtagatgcagacggttcaaaaagtcaccagatttatcgagttgaggaggtcattgaatcatttatctggattagattgtcaaacttcatgacctagctcaaatcacatcttcagtttgaagtatttttaactccattctttcagtctgaattgttggcttcctcatttgctcatcaaaagccactctacacatccatttgtgatataaaccatgagctgcttaatcctcatcatgcagatctgcatccaaacatctaccctgcacccaagcccacatgacacagtgtatgatatataatgcacatacaataacattatagagtgaatgcatgattgagtggatgtgtggaagggacagaaaattaatgctgtaagtgtcctgttagagtattgctcaaatgtggacacccgcggaatcatctcattctcaccgtagtttcctcccagtaatctcactggatttttctgtttttctaaattgacctctttgagacatttggaatgaaagccatagtttaattttggcatatctccagtactttcattttaggtatgttcttttatgcccatgacattttgaaactgttttgttgtttttcttttcttctctttaaaaataatcaccagttgtgaatagattactacttgcttggtgtatttgttttttattgctaccataacaaatgaccacaaacttaagtgcttaacacaaatttattaccctatggtttcataagttggaagtccattgcaggtcttactggactatattcagcgtgctgtgctggtgggacgggactgtgtttctttatgttggcttttggggataattgttttcttcctcattcaagtattgacagaattcagttccatgcagttatagggctgaggacccagtttccttgactgtcagcaggcagctgccctaaagtcctggagacctctctccagtccttcaacagtctcctacatctcagaaccagtcgcatggtgttgaatccttctcatactcccatctctttgaccttttgtcattgcacatctctctgtcaccatgtagcagggaaagcttcttgacttttaagtgcacagtcacccatgtgactaggttgggctcacctggataatccaggataatcttcccaactcaaggtccataaccctcatcacatctgcaaaatccctttcaccatgcgatacaacatattcacagggattaaggcaagggaatctttcagagacagttgttttttcagcctcgtctgaaatgtgctaagtgctttatatacatgtttaaagttatctccattttgccagaagaaataaagtcttagaaaaattgggcgaattggctaccttcctatgaaatgacagtcattatttaaacccatgtctacttgatcctaagtcatattgctcttaattcctataccatgctgtgctgtgtgtatatcctactatatatgtgcagcacacacacacacaccccaacatgttatgaactgagtgttatttgaaaaatcatcttgggccacataaaatgtatagcttacaccgtttcttctagtactctttacaccaattagttttgtatattagtaatctgagactcagggaaacgtggcatcttccaaactaatggcaaggctacaaaaacagaaaatatttattggccaatttattagttttcctagactttcaaaatgtagttatttcacagattagctatgaaactccaccttgatgatagcatactaaagaacatgaagaaattacattgttttagtttctaaaatagatttttaatttctaagatattagaatagttaaatagaaatcacaaaataatatgcttatgttttatatgcttataatttgggcatagttttttgagttgacaattaagttttagaattgcagtataaacagaagggaaatgtgtgagtcctttggccattccctgttgttgatcacaacacgtagaaacagctgccccaagctcttgtaaatgtatctttgccttagcccttaactatgtttttttctgttttagccatcctttttaatcccacttgtttatcttttcttaaaatgtactaactattcatagctgcagatatttttcttaattctactatcttagtttcattttctctgtggcacttgctttacagatatctcagtggagtgaaggatgtgctacatgtgctgcttcgctgatctgcccactagactccgatttgactcgttttcatatcttgctttcccagagtctgctgtcattgcgaaagcattgtttattggtctccctttcttctttgctgcagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggtaacaaacagcaatggagacttctgaacacagatgacatctaaaaatattttaaatgacactctctaaatttacctgcagttatcactgttagtgctcttccctggaagtatatataagccaaaacagtggaaagaccagcaatcttctatatttggcctgggagtgcattatacaggatatttttttccttctggcagcagatttttctttctaattatatagtgttcaaggctacaagaaatttactttgcattccctgtgaacacacaccagctgggaagcagaaggatatgtgacgactgagctgtgggtttcagcatgcaaaatatccataatatggatagtcaaattctaaggcaatataaaattaagtattattttatagatcattttctctttgtcgatttttgtctgccccgaaatatagttggaatgtctaattttgtgaatgaaagtgtttgtttttgtttttgtttttaatcaagttacttggtgaaagaagccaggtctggtactttaaaaattgtgctgttattgataatacacactcttagttttgagtgatgatttcaaggtactgatagggcaaccgtacaacaaagagaaccactgtttctctttacctctggcccttacggtttctcccagtcaggctgctttttatgtgttcagcatgttcatacccaagagtcaattctcagtagctttaaacttgaggccaaagtggggagatagatacctttttccaacctttctttgtttatagaaaacctattagacagttctttcttatagatcatagatatattgtaacacacttgggaggtctaaaacccttaagtggagtattatccaaaattaaaatagtaacatttaaataaattagaaagatattccacatatttaatctagtaaagttatgttagagttcatggttttctttctttcagaagttggtgttagttcttacgtggcaccttttggtgatttccaggtgcatcgttagttttctacaaccattagtaatggcggaaaccacgattactgttgcaccaacctaatagaaagtaggactgtgtataacatggcattatcaaatgcagacatttaaaaattaaagccttgggtaaagtatcacaattcatccatgattgggaatctcactggtattcaatcaaaatagtatatacctcacatttccaatctttttttttttttgagacagagtctcactctgtctcccaggctggagtgcagtggcgcgatctccgctcactgcaagctccacctcccgggttcacgccattctcctgcctcagcctcccaagtagctgggactacaggcccccaccaccacgcccggctaatttttttgtatttttagtagagacggggtttcaccgtgttagccaggatggtctctctctcctgacctcatgatccgcccggctcggccttccaaagtgctgggattacaggcgtgagccaccgcgcccggccagtcttttgttcttgacattaaactaacagtatcgcctgggcgcagtggctcacgcctgtaatcctagcactttgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagagaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcgtagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttgcattttataggtatattttatgtgtttaattttttcaaaagcactgttttgacttctcgagggattctcacattaagtttatcaggtccagagataccagacaatttgaaccacatggttaatactagatcatgtcataaagtgatataccaatgagaagttaaaaatatgattagaaaagctatttgttttgccagtttgatcaaagcaaaaaaattagaattgaataattaattcataagtttaggatacatataattcaatttctctagttaaatagaaacagagtagaacatcaaaagtaggcctgtcatttaaggttgactctcttgccttgtctatgagttagggaaatcaaccttaatgtggtaaaattttcaaattataaataaggatactaatatttaaccagtatagtaagttattctgacagtgaggtagtaacatcccagttttgctacaaaatatatctaaaagaatatatacaatagcatctatagttattgtgatttgtttttaaaaattgcagagaatgcgacagggtactcctgaaaaaaaaaaaagaaaagaaaaatgaacaacattttgtttttatttagctgtaactgaagaaatgttgtcccaaactttttctgttttgggtctggttgccgttgagatcgagttttccctttgtaagagggctcattgcttgcaatttcttaacccaaaaagaagaggaaaatctatactttaataatgtatttgcctgtgaataatactttagaaaagtaggatttttttacattatagatattagctcacaattacgattacttctttagaatgaattcctagatttgcaattaaatcaaagaatccacaaaattttaaggaatttttatgcctattgtcaatttatccttcagaaagattaatcaaaataccccctcatcagtggtatttgagatgcctctttttcagtaccttacccaatttaatattgtaacttttttttctttttttgagacagagtctcgttctgtcgcccaggctggaatgcaatggcatgatctcgtctcactacaacctctgcctccccaggttcaagcaattctactgcctcagcttcccgagtagctgggattataggcacccaccactgcgcctggctaatttttgtatttttagtagagatggggttttgccatgttggccaggctggtttcaaactcctgacctcaggtgacctgtccgccccaccctcccaaagtgctaggattacaggcgtgagccactgcacctggcctggtattgtaactttatgtatttgatagttgatggttaaaaatgacattgcatttatttttgaatatgaatctctatcattttatttcccattgttttaaaatagtattgtaatcttatttgatagtgctagcttgcttttagctggctttcaggttgttcactatacaagtgtgcttggctaagaaggcagagcccacaagtgctttttttttctaattctaccaaagagaccatataggatactggggaactgataccagatttgtaattttacaatgattattcaatcttcaaattttatagatcaaagtccagaaatattttcctattttagacatatggagtatttgcatatatgttttgaatttttgtaattaatcttctaaatgcagtattcataactcattttttatatttaggtatttttattaaactgaaatgaagacaattcatgccatttccccctttgatatccaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccaggtaaaatgacagcatacttccttggggcctgagacaaaagcccatagaaatactattgttacaggcagccatccattcatttaaccctctgactatgtattaggtaatatgcagtttattgtaagttacacaaattgtttaattgtgaactaagtgtatttgagcataccacaactttccctaggacaactatttttttataataatcacatacagaaacagtaggaatgttatgtaagaatagtatacttgttacagtgaaaaaaaatgggtaactttttagtaacagtcacctttcacatgtttatttattcactgaataaatattcattggatatctaccatctgtaaatagctttaaaaatcaactattgatggtgttaagggaaaaggggggattttaaaaagaactaaaacacaaaatgatagagatgatgatggattcagtagaaaaagcatcaaaggaagcagttgggatgatgatgagaaactgctgttgacttctatgacagatccattggtaaaatcctttatgcttactctttttttcttaaatactaacttttggagttgtatatggcatacgtttagagatactttttgcttgtaattaaagagacttgaaaattcaggattagcccagttggatcaggtgaaatggaagcagagtagtgtgctgtcctggctctggtattgactctacctgtcccttactgtatgaccttgaacttattacttcacttctctcagcctgtttctctttgttctggcatgagaatagaaagcatatgaaaaatacttagttcattgtaagcaatcaatcagtgttacctattgttttcacttttagccctctagataaatattaagagagggtttgctcatgtttttggtattttaatttcatttcaagccatacacatttaacataacactgtacattttaaaagataaattttcattttttctccttctgaaaatgcattgtaaatttatgctagcttacatttgaatattagtcatctgaatccatatcagatttcatgttcttgtaactatttaatgtccatttaatcactgagttgtatagattgagatttgagttgatagttcagctaagtttcccttgaattataataattataattttctagttttaaatataactgagctgatttaatcaagcgattaatatcaaagtataaaaactattttaactgatgtgatactctttgctctctatctatattttagctccagcctgggaattgcagccttctgtctgtcttctcgctggttcgtcctcatattgatattagtttccatgggatcctttctcacatcaatactgtttttgtattgagaagcaaggtaatcaagatattatttcattaaatgtgagaaaggtatgtcacaaattagaagtattcaggggggaaaattatcacattctctgagaaagtatagagagataaaacccagacctcaaaggaagatctatttaaaaggcaataacattgatttttggtttgcctgaggagcagtggaactctatcaactgattaaaattaacagaggtaaattttagagactgtctttctgagacggccttgtttcacatcaaaaaaccaacatcttttactccctgtacagctacagtgccttattttagaaatcagaactaaaaaggatttttttttttggaacttcactcaaaaccacttatttattctttcttaaattgtctattgttcttagtagcgtttttgtgggtgaataaaagtgatgaaatattcacacagttgataatttagatagtgctgggatctcacggtttctgttcttgggatagatacagcaaaagtcattttcctagagtacccattgaatcctttctgtatttggaactgactgtttgcagctgctctatgaatacagggtgggagaatggggaggcttggcttattctttgagagtctggtaatgtatgttggaaccataccggaaaatcagggggataaaaaagattcacaaaagcttgaaataattatgtgaagagtagcacagttactgtcctgaattcagacgggacagtcacttttctgcagtgttgcaaggcagccactaggcttattacaggcagaactctgacagaaggccctctcctgttctaatgatgcacttattctgctttgtggtttggtgggaaatgagatatgcgtgtccttgttgctgaattcttaggtagggagaaaggcattcattaatggttgtatcttgccttttcaaggaaggattgttggatgtggagaaattagaatgtgaggatgaactgactgggactgagatcagctgcttacgtctcaagggtcaaatgatctacttacctgaagcagatagcatactttttctatgttcaccaaggtaatcatttttagattaattatagtggctatcagtacctatctttagctaacaaaggaatgccacaatattttattccattaaatttacatattctctgaggtgtaattagattttacagcccttgttgtgtattactttataacaaggataatcttatttaatatttgctaataaactcagaagaaatcacatactctatgttatttgccatgtcttaatacatttgtggagtgtttatgccattacgccatgggacaaataatctgcattaagctaattctatagttttggaccttcaaaataggcattatgtagaaaagtgattttttaaagcagctaataggatggcataataaatacattggtatatttgacatcaaaaattatcttttctatagtatgttagcaaaaaatctaaaaggtctctttctgggtttgaactattttaaattaaaaatatttacctactctaatccaaatacactgttccaaatatattattcaattaaaatgtatgtaaaatgtgatttttaataaacgtcagagaaaaataaaactatagattgttgttttccaatttaggaaagcattttactaggagatacatgggaattcagaaatataaaaattatgtctaaatttgcttcagaacaatagaaaagataactgtggggattattgtgagatgatattctgtgtattcataattttgtataaacaaagtgtaggtgcattatgtagtaacacagtcaagaaggcatgttttggtgagctattggttaaaaatttaatctgaattccaccatgatcacttttcacttaaaaatgtggtcttaaaatttctgaaaaatgtaatacactttgtaacaacctcctgttatattattactattgtattatacattacataacaataatatataaggccaaataagaataatatattgttggcacagtagttcacacctgtaatcccagcactttcggaggccgaggtgggtggatcacaaggtcaggagttcaagatcagcctggcaaacatggtgaaatcccatctctactaaaaatacaaaaattagccaggagtggtggtgggcacctgtaattgcagctactagggaggctgaggcaggagagtcgcttgaacctgggaggcagaggttgcagtgagccgagatcatgccactgcactcctgggcaacagagcaagacactgtctcaaaataataataataataataataataatatatcgttaatttttaagtacatttaagattaattaaatattatttaactatgacatataagaataatatatcagataatataaggatatggatgtcttttccctgagaaataaatatcaggaaaataaaagaaacaaaactaagaaacataaacgctttttaaaaaaattattaagctacattgatctaaagatgtcccatctgctatcagtaagtgttttcttcttctgcctcttcacaggttgagcttaggagaatgtcagcttctcattaggggcaatttctatttatggaaagaaaggttttcttcagaaataaaagcagaaaatttggagtttatttgttaattcccatatgcagacattggtcacccagtgagaaaattgcagattgtcctatgagacatgctcaggtgtgtaggaagatttgtactcacactacataaacaaagatcaagtaaaagtagttttacttgtaaaataattctaagatgattagtttgaatttagaaaaaacttaatggttcattaaaataatgatatagggcatttttagaaccacgagaccgttatgatttaagttttgtaactcagtatgagcatttttgaccattcatttttgaacgtacaatcatgttttttctctgctcatgggcaggtctcgtatacctttggccgatgatctggcttctttctagatgtgtctttttctgcaagtggatttacatatccattttaacgaaattaaaagacaccgtgtatttcattagtaaaatctttgattgttttattttctttataggtatgctaatttttgttttgctttatgaacattgctgctgagaatatattgcattaatccaaaattctgcaaagtcaccccttttaaagaattttggataggattaattcaaaattcttcaaattattaatcccagattctccaaagacataactaaattttttccttttagagtaattattattcagagtggccagaagtaatgactttgcattaaaaaaattcaagccaaagatataaccttatgccattttaaccagttaggttttgttgtcgttgttgttgttgtttgagatggagtctcgctctgtcacccagactggaatgcagtggcatgatctcagctcactgcagcctcctgctcccgggttcaagcaattctcctgcctcagcctcccgagtagctgggactacaggcgctagccaccacacccagctcatttttgtatttttggtagagacgcgtttcaccatgttagccaggctgatcttgaactcctggcctcaagtggtctgcccacctcgcctcccaaagtcctaggattacagatgtgagccactgtgcccagcctcaaagagtacatttttaaaaagcagttaactttttacttgtcagattatcactaaaataataaacattattatgttgttggaaaaatgacacaagttacaatgatgacgcataaaattcagcaggattgaataatgtttcaaataaatgagaaaaatttgtcaaagtaaaaagaagacatgagagccagaagtaagaatgacacatagttttagatacataaattacatgctgaggctgggtcataaacgtggttgggaatttttactcattgtttccaaaagggaaaaataagcagttacaagattcatagaatacagaaagcaaaatgaaagtttctcaaaagaagcattattattcttgagagagagaataaagatagatttttttcctctccttatgatgagaaaaaatttgagaataataaattacagcctgtgttaaatacctcaacgtttatcatagagatgttttctacatgatcgtttcaatttagactgatggcaccaaaaagtgcaacctggcaaaaatgcatctcaagttcactgctttttggtagatgcttaaatatctaagagaataaactcacaatcttcgttcaattctccataattctattgtcttcagcctgatgttttgaatggtaggaggtggcaggatcagattccttgacagaaatcgggattgcattgtcatgtatataagttgagactgatcttgcctcatttctccatatgacagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacgtaagaatgtaacgcttggagcactactgttattcataacataatgtgactctactatatttaagtttgagaaccagactaaaaagccatgtgacctgtaatagctctggtgtagtaaataaaatctttcacattgcttttaaaaagaaattatgcttaaggaaataaaccagtcttaatggtggtggaaatatgtctgctatttttagaagccaagttggaataatataggccaaaatatcttttggaaaatcatgagaataactcaaattcaaatttagttcaaaaattgaagtttaactatcatttattcctgcattctttcatacaagagttatatattgaccatcttcagtatgctgggggctgccgcgtgcagagagctgctctgcacaatgaacttaaccactggccattacatgtttaaaaatttattttctgggaccttgaatttaggattagaaagaaatgaatctgacaaattgtaatattatatgtaatgacaacaattacatctatagtgacatacattagcaaaaatatcaaaatataaaacatttctatgagtggtggattcaattatgaaatattgagcaaggacatgaaagataatacttgattttcaagaaatgtatttaagtaagtacatagcatgcatactacttggccttgctttcatatgctaattaaacgcacatcactgacatttataagctattttacccaggttcttatgtgttcgttttttaatgtttatataaacatttggcggagcttctaagaccttaggactaacgttcaaagtcacatgggtttgtaggtttgagttactcaatattctgttctggctgtttgtattagaaaatcatctaggtttcattttttttgtattgtgactcaatttgctaatatctacattcatgataaatagataaataaccagcactataaataacatagcctttaaattatgacatatgcagatattctgtactgaaaaagctcttaattcacttcttttcctaaattgtcagcttaagcagagtattagcttctcttcctagaccaggagtccaaaactgggagttgctgggagttaaacagcggccttgtctttaatacgagtagctgataagtacttattacagaactacttctttgtttggattccccaaggtgggtttcacattcaggaactatttgcaccatttcgagttactgtgcttcaaaaatccttatattattttttagattattagatttagaatttggtttttgtagatatttgggtttcaaggtgatgtcattagaaaccatttactattaattttctttaaagctaagtagttttactgttcatacttactattcaaatatagctttaatatttcataaaacattcaatgtttaaaagttgaaaatgaaagaccggagaaattctactatgactaggaaaaacattgagagctcagctccattttgcatatttaaacttcccacatatgcccttttgctttagagcaaaaggcaggaagaaaaaggcaggaaggcttcatttgttcctcttcagtcttccaatccagagcccataggtctagtttctgcttctttccctctaaattcaccagctgtcatcctcctcctgtgtgctcacatttgtcccttagcatgatcccatagtagtctcagttgtacctaaagaaatacaataatttattttctagaccaacttcctctggttttatcagtttcttctatggaggagtgaggcatgaatgagactggagagaaattctgcttcttttaatattacttaccaaaaatagagacatatttcttattctaagaggcaaacctgtttccattattgtgctattcataccatgttttaggtgctggtaatgacagtcttcatactgtgactatcgtaatagcagggtcagaatacaggactacaaatgaaaactttgattttctattaccagtctttttgttttgtctgtttgcttggcttattttgatttggtttgaactagtttgggcttgcggatgtcttatgtgattaggatgaacaaataatttatgttttctgtaaatccttgcttataaatacagctaatatttgatgctaattttagaggatgtcctgctagaatccaggcctttaaagtacaaacgacactgatgctgtgtgaaaaggacagcagaagcactaaaggctttcccagtatttcttacagtggctttctgctgatcccactgaacagattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggcaagtgttctttatcgctgactgcagagctatccagaggctggcgttctgagactcccctccagaggccatgtcatcacagctctctgactccagcactgcagccttgagtacagtgagcctccatgtattcactctttaccatgttcttaaataattgcctcttgttataaaactgtctcttccttgtaaccacaatgaatgtttcatgaagtgggtgattccctggttaaaatgaaatgttcaccatcttatttgcacttaggctaacaaatctggacaggctgtttatcacatgtagtataaacatagcattcattttagtcctctgcaagagacatttttactgagatatataaatgctttgtacagtaaagaagtcatgaagcatgagaaggactcagatttgcgtttagataacatcaacttgaagaagataaacatttataaggcgtttttgccctttgtttcatttagaaataaatataatattggaaaaaagaagtcagtggaatattgctacataaaggcaagaatgttaagtaaaccatctctagatatctggggtaatataactacacaaggactatttattttatagtcattttctgaggtacactctagcatgtggtgagcacatcatacaaacaaatgattaatgaccgtgataaatcactgaacttgaaatggtggctctccatgccgtcaagccatcactgttttaggtagaaatgtaaaaaattattcttctgaattataaagttatctgaggtgagaaattaattgcttactaaaggaaaaataattctatgtctgtacctgcccgtcatcaaagaccccaagtgtccatcatgtgtgtaaattataagtaattgcaaggtttcattttgttggagttgaatatattagaattttaagagaattaaagggggagggaagcttaaagttgctggtagacttgaaaaaatatgttttttgttagggtaataaatgaaacagtcttttttatgctaaccgtgaacatctaaatatatgtactgttaggtggagactgttggtgacaagtatatgacagtgagtggtttaccagagccatgcattcaccatgcacgatccatctgccacctggccttggacatgatggaaattgctggccaggttcaagtagatggtgaatctgttcaggttagtaaatgaagtagatattgtaataatggtatgtaaacctttttggacaattgattcatatcgttgtccggaaaatcattaacgtgtataaagaagggcatcttgacaacaaagactatagcatttcatccagcccactgtactacattctttcatagacatggagatttatctacctgtttgaaattatctagtccgtttcatgtactgaaagtcatggggatgagaaaaaaacctcttgtaccttctagtttattttttaaaacctctttcatgtctcatgtaagttactagattcacatctttgaaatcttcagacttcaaatgtttctcttgagataggatatttccctggggagatagagatttcatggagggcttttgaagttgtccataatatgcttgaaattcttatagacatctcttacgatgttatatgatgactctacattattctgtaatataaagtaagcaaaaattcatgtgttacaggaacagaaaaccaaacaccacatgttctcactcataagttggagctgaacaatgagaacacatggacacaaggaggggaacatcacacaccgggacctgttgggagtttgggggcaaggggagggagagcattaggacaaatacctaatacgtgcggggcttaaaacctagataatgggttgataggtgcagcaaaccaccatggcacatatatacctatgtaacaaacctgcaccttctgcacctgtatgccagaacttaaagtaaaataaaaaaaaaaaaattcatgtgttagtgatcaaaatgattgaagcaaagctttcttttttgcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacaggtgagagaaaatgtcttggtatttactgatttgcaaagaaaatgtgtctttgcatgtggtttaattctctgagagattttgttgctttaacagagttatcaccttcactcttccccactgcttgtagagttgtttactttttatttgagaagattgtgtcattatttccattttatatgatttcacatcatcttaggaaatcctgatatgatcattgtttctaaagctttgagttacctttcagtacaacttcagcatttgttcttgccatcttggtttataacatgatacatgtcaccttctctataaaacttgtgtatacttctctctctactccccttcccttgtcttttagatgtcttatgtctccagaaaattcagatccacaattccacttggagcacagaggcccagtgtccatgaagggcaaaaaagaaccaatgcaagtttggtttctatccagaaaaaatacaggaacagaggtatgactaatcaaagtgtaatttgcgtacttaagacagagtataagtatggaaaactaaagcaaaatcactgaaaatgtatttcatttgaaaagaattcttgctaacagaaattaacttctaagtaaagcagtggaaataattgaacattaatgagccaattacaatcataagtactttttaggggatactttagtgatttttgtcctctaatgaaatgaaaaccaacagactggattgagaaggctgctttttttcttgctgttgtggttgttttgctcttcctctgtagtctggctcaaaggtaagtgggctgtgaggggctcccctgacccctttcctcagctctctaagttggctctgagatcaccacagataagggctgtggttcatgggaggtttcttaaccatgaagcttaagatccttttaaggggcaggctatctttctatggagtgattggggaattttggaaatcctagtccctcatgtgtttctcctagatagatgagtgatttttaacttgctagaatctgattaattccttagggaagatttaagttctttctactactatggttatactccaggcagagcccatgtgctagaatggacttcagaacagtggcacatccaaagtggaatcacacctctcatagaggccttgcacacactaagatcatggctagcctcttcctagccttttgtaaggagtggcatcagaagcaagtttgatactttgttaccctgttgatgtgttgtttcctcatgggggataagactgcatgctcatatttctcttttagtgtgtataaactctctaaagatgcttttagggcataacaacttctaaagggaatagaatgccagggtttgaaatatttatcttctttcacctggtttaacattaaatcattttcctatgaggtggacatgcttattgatgttcttctgataaactaagccgtaattacctcaaacattggtcatcttagtcgtgcggtcctgtttttcccagaattatggtgggaatgatttacagaaactgtagatgtgaacgtggatcacactctcataaagagaaaaatatatttaattgatattataaacctcactatcactgtaaatcaatccctcttttcttctgcctatttaaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtctctatacagtttttatttcaataaaaatattaacattatttttcattttattaatgccattattttgtaaatacattttacaattttgcctatttgctaccattataaattttcactgactcctcatagacagcatattcttaaatgctatatttctttttaataccaacagagtgacaggaaataaagactgggcatggaaaggggaaacagttaaatattgaatgtcatcagcttatttaaagagctctgaatcatttagggatgatagacatgtatacaagtaatgaaaatatgcgatattcataatgaagaaatatattcaaatgcagaaataatacttagagaaagagtaacttgaaagaaaagaggtgaagtggggatagttgttatgcttattttggggggagagttaggaatactcagaaactacattgacactgtcatcttcccagaatcctgcatatatttatttagcatctactttgggtaggtactgctcaagatatttgagaaatgtcattgaacaaaacatctctgcctttgaatacctcatattccaatttttacatcttgcatgtttttaaatctctactttattccgccaacactcttcgaagtccaggcactcatcatgtgtaacttgaacaattgcaagatcttccctataaatctgtctatttcctacctttgccacctccattccacactctcaaattgctgccagagtggtcttttacaaatccaaattgctctcctgcgtacaatcacttaaatgctactcattgtctgtacaccttagcaaagcatgtaaacattgtcaccttaaccagccttatctgctagttgctacctttgtaattctatgctctgctctgtctgaataccctctacccatactctgctgcaaattcatttcttgctaagactcagctcaatatcctcttgttggaaatttccctgttaggaaagtttagcttcccctattgtcccaggatctttacaatggttcacatattatctgtttatatataggattccttattaggctttaagtttcttatggctaaattagttcctcttacaccagatattccttgaaccttccacaaaataggcacttgacaaatatttgttgaacaaaggaatggagggagcagcctcttcgagcagtggggctagaagccagatttaaagggaaggaggaataagaaatgagatagattggagaaaagaggaggcacaaaaatggcactgttaaacttgtgcttagagaaaatcatgctgacattggtgcaggggctaatttagagggaaagagcctggtttaaggttggcattagggggctactgtacttcatgcataggcctgctttaaggtgatggcaggacaggaggctaattgaagagcagtcaagattcacattaaaagtgcataataacgcacaggccaaaggggatgagaaggttagggccaagtagaaagcttctggcttgcttagtgggtagttgatggttccattacacgtggtggaggatgtagaaaggtaactgagcttagaggaaaggtgcctaatattaggcatggctttgaagttctggtgaatacatttttaaaaaacaatgattttcaggtagcattaatgcgaggagagaatagaacttttttttccaagttgggccaaactgctttgaatttccaaacaacctgttactagctccatgatattggtaaagtcatttaacctttgtgtaacctggttaggtcattgtaaagacagagattataataaccactcactagagttgttggcagatcaaactgaaatacgaagaagtcagaggagttggaactttggcttgccatttcagaaagactaaaaggtaatctaagaaatgaaaacttacaaatctttggtaacagatattgttatagttgaatcatggacagcacatgtcatgaaaaaacaggagggtcaacaagaaaaatcaataaatacatttatctttgccaattattgaaacaaacccagtggaaaccaccaaaaaattagaaccaaatgttgtgaaacgataacagtttatcagtttgaactgaattgttttaaactttaacaattaaataccattttaaaggtatgtatttttaattatataagttatatatttattatattatagattacatatattatatgtatcttagcactaattcactatttcattcagtttaaatctgtatttgattcaccaaatgatatgttctatttcctttgtcattgaaaggaaaaataatttgcttacctccctcataggtttctttctttctttttttttttgtaccaccctcactaatggtttatagaacctctagagggcagcagagaatgctgtttgtaattgaaatctgaaaaagaactgaaaggagacattctctcacaggacagagttcatcttgtctcctagctgtcacttcctgtgtgcaaccttgaattcactccttccactctttctcaagttcaaaggaatataataaaaataattatttctactcattaagaccatttgtatagcatgaaatctatccacacgtatcttgctctgaaatgtcaccaaaatatttcctgctaattctgcaggaaggtaaaaacatttgctaaaacaagcaatttgtaataggaacaatagttttgtacaatatttttatgagtaaactaacttgcttgtagctcatgttaaaagttattaaatagaaataggatactatttacttataaggataaaattggaaaaaaatttattttacattaatagaaaatgcttttgtgattcttccttgctacttataccgtatcaaagagaagaaatatagtgtgagttaacaaaacaaaatttaacaaaaaacaaagcaccgtacagagaatcaagaacctgagtccaattctggtgaggaaatcttgtggcctttacaagtcacttaactttacaactcagttacctcatctgaaaaaaaggagctggttaaggtgatatccaaactaaattattgctccaaaattccatcatttcgttggtaacaattccagggtttttgtatcagaagcattctaaccaaagtgactccatctttacagaggctgggtaaaatgaggctgagacctgctgggctgcgttcccaggacgttgggcattcttagtcacagaatgtctacagttaagggaataggttaataatgtttaccaaacagacccaggacttaacagacccaggaaatgtccaggtgtcccaatatcttaggaataaatgtattcttaatttaagaatacgttttgctttaaagataataatacagattattgtagaacagtagttaagcaaatactcagctgataaaacaccatgcagtaaagaagcaggccgaaacccaccaaaaccaagatggcagtgaaagccacctctggtcatcttcactgctcattatatcccaattataataaattagcagtttaaaagatgctcctactagcgccatggcagtttacagatgccatggcaacatcagaagttactctatctggtctgaaagggggagtaactctcagtcctgggaattctccactcctttcctggaaaactcatgaatattccacccctcgtttagcatttaatcaagaaataatcataagtttactcagtccagcagccatgccactgctctatggggtagccattcttttactcctttactttcctaataaagttgttttcactgtactctgtggattcacctcagattctttcttggatgagatccaagaactctctcttgtggtctggatcagtacccttttccagtaactcttgtgctaggattttggcctgaaacttttgggaatacaatctaaagttttgacaatctagtagtgttgaatagatcaaccgaaagactgaaagctaacttccaagaaataaacaaatctgaggtaaacacttggtgaggacttttgactccaagctaaaatcaaaatgactaaggtcctgattagtgtatatgagtattaatgttatgtatgtctactaaaaatgtgccctataatatttaattatgttagctaaatttaagtgtttaataaacagtcacattcttgatgacctgaaaacaaggagagaatgtatgtctctatttcaattatatgtactcacacaattgctgtggtacagtctatcccaaatagggcttaaatataggggccagtcatggtggctcacgcctgtaaaccagcactttgggaggccaaggcaggtgaatcacttgaggtcgggagtttgagaccagcctagtcaacatggtgaaaatgtctctacagaaaatacaaaaattagccggatgttgtgatgggcacctgtaatcccagatactcgggaggctgaggcagcacaatcacttgagcctgggaggcggaggttgcagtgggctgagatcactactgcactccagcctgggcgtcagagcaagaatctgtctcaaaaaaaattacaggtaaaaaatatcagtgagtattacatataggttggggtttttaaaatgttattcttatgaaatatatttcccaattatgtaaagtagtgaccacagttgcctaccaaacagttttagatcattagggggaaaggagtcacataaaattaaagtattaacttagaaaacacttttaaactgttgtaaatactgtcccttttgtggttttctgcatcacatgaataaatgtcaatatattaataatttttatatacccatgaatataataccatcatattgttctggacaacaacagtacctaaatctgacactgtgactacatacagttttagatgtactagtacaaataacgtaatcaaagatattttgtttatttttgtgtaaaaatcattacagtctaaggcaggcatgggtgaaatcagcgactgagtcctctgctcccgggcaactggggctctgaagagggggggtcaggggagtcccctgagaagtttgtgtcctggaatccaagacaaggtgagggcagggcctgaagaaaatacaagtctcaggaaatatgtagatttcaaattgatctgacaaaaaaccctagtggtctgtccaaagaagccagtagccagaagaagcattacaggcaggaagcattatgaagttaagtgtgtctggtgttggaagccttttgcacagtgctagtttgtgtgtgcagtggtgattttggcacctgtttaataattgtatatcctcaatcgcaagtattggacaggatattgaataatgggaggttgcaatttcttaatgtgttagtataactattttttcctctaaagcacagtgtttttaagtctgtttagaaaacttccaggcgcggtggctcatgcctgtaatcccagcactttgggaggccgaggtgggcggatcacgagatcaagagtttgataccagcctgaccaacatgttgaaaccccgtctctactaaaaatacaaaaattagctgagcgtggtgtcacgtgcctgtaatccaagctactcaggaggctgaggcaggataatggcttgaacccaggaggaggagattgcagtgagctgggatagcgctactgcactccagcttgggcgacagagcgaaactccatctcaaaaaaaaaaaaagaacactgcaagggtaatgtctaacagcatggtttaatagtaatacaatgtgaggcccaaatataagtcacatatgacatggatttttaaatttaaaaatttctagtagccacacttcaaaaggtagaaaccagtgaaattgactttaataatatgttttatttaactcagtataagcaaaatatgatcatttcaacatgtaatacatttaaaatcattaattaaatatttaaaatcagtgtgtattttaaaatcagtgtgtatttatacactttaaaatcagtgcgtatttatacactttaaaatcagtgcgtatttatacactaaaatcagtgcgtatttctacactttaaaatcagtgtgtatttatacactaaaatcagtgcgtatttatacattttaaaatcagtgtgtatttatacactttaaaatcagtgtgtatttatacactaaaatcagtgtgtatttttacactttaaaatcagtgtgtatttatacactaaaatcagtgtgtatttatacactttaaaatcagtgtgtatttatacactaaaatcagtgtgtatttatacactttaaaatcagtgtgtatttatacactttaaaatcagtgcatatttatacactaaaatcagtgcgtatttctacactttaaaatcagtgtgtatttatacactaaaatcagtgcgtatttatacattttaaaatcagtgtgtatttatacactttaaaatcagtgtgtatttatacactaaaatcagtgtgtattttacattttgcagcacatctaatttcagaccagccacttttcaagtgctcagtggtctcatgaagctagtggctatcatattgaacagtgcaggtctacatatacaggttattgattggatcttttatccaaaacaatcatcttagatacttgattgttttgtttcctccttaccagaagattggatcaaccttgttatttataaaaacaaaacaagtagctgagtagttgaaggggtcattaaattaagaaaaaagagtataggaaggtttatactttttattctgatttataagatgtagttttgaatagagtgtttcttttgaactctaacattctatatactacaacataatataaatggtgataaaaagagtaataaaggaaaatgagttctatatgaggtatttctcaaacaacatttgcagaaaagaaagtgtactattttataagttgctaacattagcaacttcatgatttgagatgataaaggatcttacatgttcacctgacaattcttttgcagtcttttaataagaagcaattataaagcactaagaagcacctattatcttttgacaaagttaaggctctttataaagatctagttcatcagtcagttaccacccacatcatatttctttttttcatttgtattcctgttaaaggttctttccctgtcaacccaacttactctttttgcacttgacagtaatattaccaaagtattaactgaaagagaattatgcaaaagttgactaccaaaagatttgtacccttgaatacacaggaacaattttcacttgatttgtgctcagtaaagtgtatcagaaagttcagaacccttcagacctcaggaggagcaaatgttcctgtcacactgaccatatgtctttttgtgaatttaccaaaagttcttcctgattcatgaatgtttgaaattcaaaactcattgtatacagcttgttggatttcttgacatgtaaagcacttttaaaaagagttcttttaaagatagtgttaatactataataaaagttataaaatttgcttttaaaatatatatttctttaaatattgtgctgtattataactgaccatcaaacaacagacatgagagttgagataagtggtgaccagatccctgctgccctcaggctcacaactaccagcatggaaatcagggagcaatcctgcagtcactgcaagttcaatggtgatttgaacgttttacatgtttaatccttgcagcaatttattaagtatatactcttattatcgactccattttactcatgaggaaactggagcacataaagtttggggaactgcccaaatgttaaacagagagtgagtgggtaaagccagtatccatacccagacaaatggattccagagcccaagcttccaactaggatgctcggatgcatctcatagcaaaataagcaagcggctggcaagtggcgtacatctggtgggcgttttaacaccagatgagtgtgtgtcaggtaacaaagttctagtcaggcaagcaggcaaggagtgtgaagaagatatggcaggtggtattggccctaaactttacgactaactctgaacaacaggatgtggaaggctggggcacaagaagtgggggctgaggcagggaaggcaaacatgttcccctaaagatggatcacaagacagcgattataaaggctagaccgggagaacctatatgttgtgcaggaggaaaaacagcctgatgct

SEQ ID NO: 37522 - DNA, 169659 bp, Homo sapiens; identical to SEQ ID NO: 36262

SEQ ID NO: 37523 - DNA, 41598 bp, Homo sapiens; identical to SEQ ID NO: 36249

SEQ ID NO: 37524 - DNA, 111733 bp, Homo sapiens; identical to SEQ ID NO: 36188

SEQ ID NO: 37525 - DNA, 60336 bp, Homo sapiens; identical to SEQ ID NO: 36480

SEQ ID NO: 37526 - DNA, 92061 bp, Homo sapiens
agtgggtcttctcactcttttccaggctccttggaggtcactgccctgatgacaacatggtcttcccttcaaggaagccacgtttctaagagggctctggcatatgcattggtgagttgaagcttgacagtgttatagcttctctgctgttagtgtgaggtttgaggattttactttaaccacatggattagtcagagaaacagaatgaacaagatacagatggcgctgtagacatagctatagacctggaagaggggctttataatggagattggcctgagtgattaggagcctaagaagtcccacagtatgtcatctgcaggttgaagagccacggaagctgatggtatcattcagtttgagcctgaagttctgagaaccaggagcttcaacgtcccagggcaggagaaggtggatgtcccaggtccagaagagagtgaatttgcttttcctctgtctttttgttctatttgggccctcagtggattgaatgttgcccacctacattggtgagggcagatgttttttactcggtctactgattcgagtaccaatctctttgaaaacaccctcccagatgcacccagaaataatgttgcacctgctatctgggtatcccttaacccagtcaagctgacagctaaaagtaaccatcacaccacactttcacaaacacctgggtgcttgcggactcaccttttacaatggttttaccagcctcctccacaagcacaggcaaagtcagtttcaaggacaggagccccccattgttgctcggtgtactggcgatctaaacaaacacgtgcattatagggggtttctgtcattttttagccacctcgctttcatccctggtcctcatgaccccttgatttctttctgaggaattccctccctcccactgtgagaacagaggggccaggccctccgtctgtctcccagctctaggagagccaggggttgagccccaggccagagctcagccaatcagaggctgtcctgtgagcaagtgataccgggactgatgggatggctggagtgtgtgttgcacagatgcaacagcagcacactgaccagaccatgcccctgtgagagccggggtggggctccactgctccctagggctcccaggagctctgcctgccctcagcttcctgtccaggctctctgaaccccctcttattattttgtttaatttttaattttttttagatgaagtctccctttgttgcccaagctggagtgcaacagtgtgatctcggttcactgcaacctccgcctcctggattcaagtggttctcctgcctcagcctcccaggtagctgggatcacaggcatgcaccaccacgcccggctaatttttgtatttttggtagagacggggtttcaccatgttggccaggctggtctcgaactactgaccttaggtgatccccctgccttggcctcccaaagtgctgggattacaggcgtgagccaccacaccttgctgcaccctctcttgttgatccttcttgcttggttaggcagagacagcctccaattcttgcagctacaaggcccgcacatgaaggacaaaatgttttggttaataatgtcttcatgtgtgtaagtcctgtttttgttttccagttgaattgagagttccttttgggcaggaactcttttttccctttgtcctgggtccggtacttggcatgcagtagattctagggcagagctggaggcagggggaggctgcctagagccagagggcttgtgtgtgaggtccgcccctgcactcactcactgggggaccttggctgagtcccgcggcattttcagtctagacattgcatcaattaaacaggtgtgatgcttataatgatcaccctccttcttggcctcagggcctctgtgaggttttaatgaatgaaggctgaagaaactccacagagatggtgactttcccccagcacagctcttgccctcaaggaagagacactcgaccaaacaggcaactggaaacaggatggcttcgtgggcgtgtgtgacttacacagggctgtgcactcagaagaatcccgtgactgacttaggctctgcagctgccatcttgaaattcttaataacttttgaatggtgttgggggtggggttggaggggatggtccacactttcattttgcactgggcactacaaattatgtgaccggctctgattaaaatgctacaagaactaacatgaaactggacacagaaaccagaccccagagcacataccgtatgagtccattggtatgaagtttaaaaacagatggcactagtccaaaggattggaagttggaatagtggttaccaggactggggggaggaagggatggtggatggtgaacaaaaggaccttggagggctcctggggttctaggaatcaatcttccttctttccttccttccttccttcctctttctctctttctttctgtttttatttcaataggtttttaaggaacaggtggtgttggttacatgaataagttctttagcagtgatttctgatattttggtgcacccattacccgaataaaaatcttctctctttcttcctctctccttccttccttccttccttccttccttccttccttccttccttccttcctaccttctttccttcaacagaatcttattctgttgcccaggctggagtgcagtggtacaattatagctttttgcagcctcaacctcctgggctcaagtgatcttcctgccccagcctcctgagtagccaggactacaggaatgtgccaacatgcctggctaattttaaaaaattttttatagagaagaggtctcactatgttgcccagactagacttgaactccttccctcaagtgatctttctgcatcagtcttccaaagtgctgggattgcaggcatgagccacctcacccagccttagaaatgttctgtttcttgacctgagagctggatatacaggattgctcactttgtgaaaattcgctaaggatttgtgcacttttctgcatatgtgttaaactgcagtacaaggttaaaagaaaatgtgtgaaacgacctatacattgcaaaggaaaggccagggtgttgagcttgacccaccttggggatgctcagagaaggcttccctggagaggggtctgggtcaggtcctgaaggaggagcaagggatgggggttgggaagttttgtggctccctaccaagggatgacgtgcctgtctggcaggagctaggctcatgcatggctcgggagagcacctgcttgtactgagtctggctctgcctgggagcttgaggatgcgaatgaattggagacacaaagaccagcttgtgggggccgtggactccactctctgggctcgagactccagctgcagtgtggaggacagcctggggtgggagatgggaggcagggagaccctgcagaggctactggacttcccaggtgagcagtgatggtgtcttgggctgggggagtgtagacaggagaatggattctggagactttattccagtggtagctgtggtggtcttcacataggatcacaaattccttggcatttgtcccatcaagagatgaagtctaatttcatccctcttttttttttttttttttctgaaatggagtcttgctgtcttgctcaggctggagtgcagtggtgcaatctcggctcactgcaacctctgcctcccaggttcaagtgattcttctccctcagcctcctgagtagctgggattacaggcacatgccaccacacccggctaatcttttattttagtagacacggggtttcaccatattggccaggctggttttgaactcctgacctcaggtgatccacctgtctcggcctcccaaagtactgggattacaagcatgagccactgcacccggcttttttttttttttttttttttttttgagacagagtctcactctgtcgcccaggctagagtgctggagtgcaatggcgtgatctcagctcactgcaacctccacctcctgggttcaaccaattctcatgcctcagcctccccagtagctgggattacagacgcctgccatcatgcccagctaatttttgtatttttagtagagatggggttttgttatgttggtcaggctggtctcaaactcctgacctcaagtgatctgcccacctcggcctcccaaaatgctgggattaggcgtgacctacggtgcccggcctaattccatccctcttgaatgtgagctggccttagtgacttgcttctgatgagtagaatgtggctgaagggatactacacgacactccaggctagattagaaaaggccatgccacttctgtctggctcccttggaactcaacaggcgtgctgcaaagaagcccaggctataaggcaaggccacatacaggtgatctggttgactgccctactgagatcccaggtgacagttaatctcaagtccagatatgtgcaagcagaagttttcaagatgaccgcagctgcatgagcctctgaatgagagctgcccggctgcctggctgggagcggtgatttttgccactgagtttggctggtttgctagcagcaagaaaacagcagcctaggctgtttcgaggaatcactagagaagcttaaaaacttcccaccgcccaggtcacgcccaagcattatttttcggagctcccaacatgcatccaaggctgagaaggagtgcaggaggccaaccctgaggcccctgagcctcagtggagacagcagtctgggccgatgtcacgaaacgcccctttcctttccaccacctcccttcactcagctctcttttgtctccgcccacttgtttccatcttcagttcctggtagatgaaagggatccatttaagtggcagggactttgaaatcagtgtgtcagtccctgatgcttgtttattttcaaagcaacataggagaatggatgtggaggggaagcggggaggctctcaagggcagtagtgggaataggattgccagataaaatacaagaggctgtattaaatttgaatttcagataaaccatgaattttcttttcggtagaagggtgctccaaatattacatggacatacttatactaaaagattacttgttgtttatctgaaattcaaatttaatcgaatgacctatatttgtatttgctaaacctggcaactctaagtgtgaagccaggtcaaggtgacacccagaactcatttagggacatttgcagactcccaagttccttcaccagcaaagtaggaaacctctcaggaatcctcaggctcttcctcttatttagagaaagtgaggctccaagacaggaagtaacacattcaaaacaggcaattcttggtttgcacattatcatggtcactaaacacatgtatactgaaaccgtgttcttgctttgctgctatgaatatttgcatagaggtttttgtattgacacaaattttcaactcagttgggtaatgcctgggattgtgattgctgggttgtataagtctatgtttgactttgtaagaaactgccaaactgtcttccagaatggctgtaccattttatcttcccaccaggaatgaaagagagtttcaatttctctacatccttgccaacatttattttccattaattaaaaaaaaatttaaggctgggtgcggtgactcatgcctgtaatcccagcactttgggagattgaggtgggcagattacttgaggtcaggagttggagaccagcctggccaacatggtgaaaccccatctctactaaaaatacaaaaattagcggggtgtggtggcaggtgcctgtaatcccagctacttgggaggctgaggcaggagaatggcttgaacccaggaggtggaggttgcagtgagctgagatagtgccactgcactccatcctgggccacagagtgagactccatctcaaaaaattaaagaaataaaataaaaaaataaaaaataatagctatcctagcagctgtgagatggtctgtcattgtgattcagatttgcatttccctaataattagtgatattgagcatcttttcatgtgcctattggccatttgtatatcttctttggagaaatagctatgcaagttctttgctcattttggggttttccatgaaactcctacaactcaatgacaacaaaaaaacagtgcaatatatatatgcttgatattaaacccttatatataagatacaagatttgcaagtgtttcttctcgttctgtgtgttatcttttcactctcttgacagtgtctctttttttttttttttttgagactgagttttgctctgtctcccagggtggagtgcagtggtgtgatctcagctcactgcaacctctgcctccagggttcaagtgactatcctgcctcagcctcccaagtagctggtactacaggtgccacccaacaccaggctaattttttgtatttttagtagagatggggtttcaccatgttggccaggctggtcttgaactcctgacctcaagtgatctgcccacctcatcctcccaaagtgctgggattacacgcatgaaccaatgagcccggttgatagtgtcctttgatgcataaaagtttttaattttgatgacatccaatttacagtttttttcttttgctacctgtgcttttggtggcctatttgagaaaccattgccaaatctaagatcatgattgcccctatggtttcttctgtgtttgactttaggtcttacgttcaggtctttgatcaatcttgagttaatttttattcatagtgtaaggcaagggttcaacttcattcttttgcatgtggatatccagcttccttggcaccatttgtgttttttttttccttttccatatatattcttcttatgtaaggcaccatttattaaagagactgtccttttcttattgaatggtcttgaaattctcgtcaaaaatcagtacgcgagagggtttattttctgggctctttattctagcctattggactatatgactatctgagaccacaatgttttttgttttttttgttttttgagacaaagtcttgctctgtcatccaggctggagtgcagtggtgcgatctcggctcactgcaacctctgcctcctgcattcaagtgattctcgtgcctcagcctcccaagtagtagacaggaatactactaactgccaccatgcctgtcttttttttttttttttctgtagttttagtacagacagggtttcaccatgttggccaggctggcctcgaattcctgacctcaagtgatctacctgccttggcttcccaatgtgttgggattacaggcatgagccatctgcctggcttcatagtattttgattactgtagctttgtagtaagttttgaaatcaggaagtatgagacctccaactttgttcttctttttcggttattttggttatttggggtctcttgaaattccatacaaattttaggaccagtttgcctacttctgcaaaaaaaatgccattgggattggataggaattgcactgaatctgtggatggctttggagaacattgttgtattagtctgcttgaactgctataacaaaataccatgacaggtggcttaaacaatagaaatttatattcctcacagctctggaaactaaggatccatgatgaaggtgttggaaaagccagtttctcatgaagtttctcttcctggcttgtccatgaccaccttcttactatgtccttggatggtctttccttgcatgcagagcaagagaaagctctctggtatctctgccaggatagggacactaatcctattgaaccaaggccccaccttcatttaacattaattacttccataaaggccctatcttcagaaacagtcccattggtggttagggcactgacatatgcattttggaagaacactaacattcagcccataacaattgtcatcttaacaatattgtcttccaatccatgaaggcaagatgttcttctgtatatttctgtttaatttctttcagcagtgttttgtagttttcgatgtacaaacttgctcctccttggttaatttttttactaaatattttattcttgatgttactgtacatggaattgttttctcaattttcttttcagattgttgtttcctactacttagaaatatatatcctactatatagaaactgattcttgtgtgttgattttgtatcctgcagctttgctgaatttattagctctaacagttgtgtgtgtgtgtgtgtgtgtgtgtgtgtgtgtgtgttgggtgggtattcattaggattttctacatataagattatatcatctaccaagagagataatattacttcttcttttctaacttggctgcctttcatttctttatcttgcctagttgctgtgactagaactcttagtactacgctaaatagtagtggtaaaagtgggcatccttgtcttgttcccaatttagaggaaaaaaatcttcagtctctcattattatgttagttatgggcttttcttatatggtcctaataacgttgaagaggttcgtttctattcctactttactaagtgttttatcttgatgttggatattgtcaaatgctttttcggcatcatttgagatgatgattatgatgatgatgatgattattattattatttgagacacagtcttggtctgtcacccaggctggagtgcagtggtgtgatctcagcttactgcaacctccgcctcccgggctcaagtgactctcctgcctcagcctcccaagtaactgggattacaggtgtctgccaccgcacccggctaatttttgtatttttagtagagatggggtttcaccataatggccaggcttgtcttgaactcctgacctcaggtgattcacctgcctcggcctcccaaagtgctgggattacaggcgtgagccaccgtgccaggcccatttgagattattatgtggttttccccccttcattcctttttttttttttttagactgagtttccctcttgttgcccgggctggagtgcagtggcacgatcttggttcactgcaacctctgcctcccgggttcaagcaattctcctgcctcagcctcctgagtagctgggattgcaggtgcccatcaccacatccagctaattttttgtatttttagtagagacagaatttcaccatgttggccaggctggtctcgaactcctgacctcaggtgatccacccgcctcagcctcccaaagtgctgggattacaggtgtgagccaccacacccggactacatcgatttatttttatatggtgaatcaccattgtgtctctggaataaattccacttgttcatggtatataatcttacaaatacgctgccaaattcgttagtattttgttgagaatttttgtgtttatgttcataaggagcagtggtctgcagttttcttttctctcagtgtctttgtcttgctggcctcatagaatgtgttctttcctcttcaatctttagaagagtttgagaaggatttgtgttacttctttaaatgtttagtagaattcatcttgaaacaatctgttcctgcgcttttttgttggaaactttttgattactgattcaatatccttacttgttatagatccaatcagattttctatttcttcttgagttagttttggtagtttgtgtttttctaaaaatttgtacatttcatctaaggttttctgattttttggagtacaattgtttatagtattatccaatttatttctgcaaaacagtactgtctcactttcatttctgattttagtaatttgactcttttctctttttttcttagtcaattttgttgatctttaaaaacatcaacttttcactgggtgtggtggctcactcctgtaatcctagcacttttggaggctgaggtgggtggattgcctgagcccaggagttcaagatcagcttgggcaacacggtgaaaccctatctctactaaaatacaaaaaaattagccaggcatgatggcgtgtacctgtaatcccagctactcaggaggccgaggcaggagcattgctagaacccgggaggcggaggttgcagtgagccgagactgtgctactgcactccagcctgggcaacagagtgagactcgatctctttaaaaaaaaaaaatcaacttttattttcattgatttcctctatcatttttctgttttctgttttgtttttctccactctaatctttgttattccttctttctttttcttttcttccctttttttttttttgagatgaagtcttgctctgtcacccaggctggagtgcagtggtgccatctcggctcagtgcaacctctgcctcccaggttccagtgattctcctgcctcagcctcccaagtagctgggattacaggtgcctgccaccacgcccggctaatttttgtattattagaagagacggggtttcaccatgttggccaggctggtcttgaacttctgaccttaggtgatccacctgccttggcctcacaaattgctaggattacaggcatcagccaccatgcctggccttattccatctttctgctagctttggttttagtttactcttctttttctagttacctaagccacatagttaggttattgatatgttagtttgctagggccatgataacactttatcacgaagtgagtagcttaaacaatagaaatttattttctcacaattctggaggctggaagtccaagatcaaggtgtcagcagggttgatattttctcaggcctcaccccttggcttgcagatgctgccttctcactacaatcccacgtggtttttcttatgtgtacacacatgctactgttcagatctcttcttctctgttatgacatgaggtcttgctctgtagcccaggctgtagtgcagtggtgagctcatagctcactgcagcttcgacctcttgggctcaagcaatcctcctgccttagcctcccaagtcgctgtgactacaggcatgtgccaccaaacctggcttatttttttttaattttatttatttatttatttatttttagagaccaggtctcactatgttgctcaggatagtcttgaatcctgggctcaagtgatccacctgctttggcttcccagggattggtagcataagtgctgggattacaggcataagccaacatgcccatattattttcttactttccatcctttcgaatcttttgatccaaagtaagtctcttgcagacagcatataaattaataatttttagaaatccattctatcaatctctgccctttaattagacagtttagtccatttacatttaaagtaattaccaataaaggatttaattctgccatttatttaatagctatttgcttttctgtacattttttaaattttgttcctcaattcctccactactacatttttttggtatttaatagattttagtgtatcattttgattccttttttctttccctgtctgtatattttttagttattttcttagcggttgccttggggatcacaattagcatcttaaatttataacaccctaatttgaataatactaacttagttttaagagtatacaaatactttgctcctatacatctctttccctccctctttatattattattgtcccagatcatatctttatacattctgtgcccattaacatagatttataattattgtttcatgcatttgccctttaaatgataggtgaaaaacaaagtattatgaacaaaacctacaataatactggcttttatatttactgatgtatgtagttactatttttatcagtgttctttttttttctcatcatggctttgaattactatcaagtttcctttcatttcagcctgatggattcattttagcagctcttgtagagcagggctactagcaatgagctttctctgcgtttatttatctgaaaatgtcttaatttctcctttattcctgaaggatagtttgtctggtaggaaattcttggttgacagtcttttttttttttttccccaggactttaactgtgttattccactgcctctgggcctctggttccttttcttttcttttcttttcttttctcttttctttttttttgagatggagtctcacactgtcatccaggctggagtgaaatggtgccgtcttggctcactgcaacctctgccttccaggttcaagcaattctcctgcctcagtctcccaagtagctgggactacaggcacccgccaccacgcctggctagttttttgtatttttagtagagacagggtttcactatgttgaccaggctggtctagaatgcctgacctcatgatccacctgccttggcctcccaaagtgctgggattataggcgtgagccactgtgcccggcacttaaaaaaaatttttttttgagatggagttttgcttttttagagttttgctcttgtgcccaggctggagtgcagtggtgcaatcttggctcactgaaacctccacttcccaggttcaagcaattctccagcctcagcctcccaagtagataggattacaggtgcccaccaccgcatctggctaatttttgtatttttagtagaatggggtttcgccatattggtcaggctggtctcgaactcctgacctcaggcgatctgcccacctcggcctcccaaagtgctggaattacaggcctgagccactgcacccagcccctctatggtttctgatgaaagcttagctattaatgttactgaggactccttgtaccttacaagttgttcctctcttgctgctttcaagattctctttttgtttctgatttttgacaatctggctgtgagtttcagtatgaatctctgagtttctcgcgcttgtaatttgttaagcttcttggacgtgtatgttcatatccttcatcaaatttgggaagttttcagccattatttcttcaaatttctttttctgtcccttcctgttcctcttctccttcaggaacttctactatgcatatgttgatatatgcttgatggcatcacatggatctatcaggctctgttcatttttccttttcttttttttgagatagagtctcactctattgcccaggctggagtgcagtggcatgatcttggctcactgcaacctcctccttcttgattcaagtgattctctggcctcagcctccccagcagctagggttacaggtgcgcgtcacaatgcctggctaatttttgtattttagtagagatggggtttcaccatgttggccaggctgatctcaaactcctgaattcaagtgatccaccctcctcggcctcccaaagtgctgggattacaggcatgagccaccatggccagcctatttttcgttatttatttttctctctttacaactggacaatttcaattgccttatcttcaagttcactggttctttcttcttcctgattcttcagatcagctttttgatctctctagtgaatttctaagttcaagctattgtacttttcggctccaggatttctattttgttcctttttataagattaaactatctcttcattggccttccctatttgttcatatattattttggtttcctttagctcattgggtgtaagacagttgatttaatgtctttgactaatgtttccaatgtaaaggcttccttggggatggcttctattgaattctttttttccccctgtgaataggctatactttcctttttctttgtatgctttgtaatattttgttgagcacttggcattttgggtattattgtagtaactctgaaaatcagattctcctcctcttcagggattgctgatttttgcttgttgagggttgcagccatctgtttgtttagagacttttccaaactatgtttgcaaagtgtgtagtccttattgcatgtggttactgatgtttttgtttcataatctttacaggcaaccagtgacctggaaatgatatctgtaaatttctggctacaaaaaggtgttctttactttcaaatctcctgatggatgctgccataggaagcacaagagggctgaaaccaatacaggagtctgtgctaatccctcaggactcaaaaatgccccaatttttggaggacaagggtcatcttgcccaccttgcaaccagccagccattccaggaaagctattcctgcagcctcatggtagggtgagggctgagaaatggggcatggcagctgttttgcatccaccctgttgctgttctcttaccaacaaccagcagcctcttttttcatcaagaactcccctggctgtttattcatgtctcatgaggtttgcctgtctaattttttgtatctttagtagagatggggtttcaccatattggccaggctggtctcgaaatcctgacctcaggagatccatctgctttgggctcccaaagttttgggattacagatgtgaattattgtgcccagccaaggctgggtaatttgtaaagaaaggaggtttatttggctcgcagttctgtgggccatacaagcatgtggcaccaacacctgctcggtttctggtgaggcctcaggaagcttccaatcatggtggaaggcaaatggggagctgcacgtcacatggcaagtggaagtaagagctagggagcaagagaggaaggaggaggtgccaggctcttttaaacaaccagctttcatgtgaactcattactgcagaagagcagcaaaccattcatgagggatccgcccccaagacccaaacacctcccactaggccccacttccaacattagggatcacgtttcaacatgagattttgagggaacaatatccaaaccatgttagtggccctctattgactccaacatctatgaacagggctggtgcttgccttggtcaactcttgtctcccattcccagtggggggcctggcacatgaagaagggattaaccaataataagtaataaagtaataaggtaataaaataatatttactttttttttttgagacagagtctcactctgtcacccaggctggagtgcagtggcaccatctcggctcactgcaagctctgcctcccgggttcatgccattctcctgcctcagcctcctgagtagctgggactacaggtgactgccaccacacctggctaattttttgtgtttttagtagagatggggtttcaccatgttagccaggatgatctcgatctcctgacctcaggatctgcccacctcagcctcccaaagtgctgggattacagacatgagccactgtgcctggcctaccatttttttttttttctgagaggagtttcactcttgttgcccaggctggggtgcaatggcatgatctcggctcactgcaacctccacttccagggttcaagtgattctcctgcctcagcctccccagtagctgggattacaggcatgcaccaccacacctggctaattttgtatttttagtagaggtggggtttatccatgttggtcaggctggtcttgaactcccgacctgaggtgatttgcctgccttggcctcccaaagtgctgggattacaggcgtgagccactgcgccttgccaatttttttttttttttagacgaagtgtcattctgttgcccaggcaggagtgcagtggcatgatctctgctcactgcaacctctgcctcccaggttcaagcgattctcctacctcagcctcccgagtagctgggattacaggtgtgtgccaccacggcggctaatttttgtatttttagtagagatggggtttcatcatgttggccaggctggtctcaaactcctgacctcaaatgatccgcctgcctccacctcccaaagtgctgggattacaggcatgagccactgcgcccggccaaagctgatcatttgaaagtgtgataagtgctacaaagaaaatttaaaaagtgaggtgagggcagatgcctagaggagaggggaggggcttttgtggacaggagatcaagaaagccctgttattatttgaactgaggcctgagtaatggcaaggaggcaaccatggaaagatatgggagaaatattgcaggcagagagatcagcaggtgcaaaggccctgaggcaggaactagtctggagtatctgaagaagagagaaattgttgtggttggcttgagtggtagggggcttggttggaggtggggaaggtgggtccgacaatgctgaattctagtaggatgtctggatttgattctggttgctgtgggaagccatggagggccctagaagggagactgacatgacctgatcccctttgaaaagctcacccagactgctgagtggataatagtttagaggtgtgcgaattggatgtctttggctgctcatgatagaaaattgtcctggtcatttagaaaatttactggccttttaaacgggaagttcagaagtgatgcagactccagagctggttgattcagccctggatcaagttctgtgatgctgtcaaggattgggttctgttctcagctctgctgaccacagatcgcacttcattctgagtactggagtgtctaggtggtctggggggctgtctgatacacatggggctacctgctttgcacttcctggccaaggggatagactgattccttatgggagcacttttgaagaatgaggaagaaccttctcaggagaggcgtggtggctcttgcctgtaatcccagcactttaggaggccaaggcgggtggatcacttgaggccaggagtttgagaccagcctggccaacatggtgaaaccctgtttctactaaaaatacaaaaattagccaggtgtggtggcacgcgcctgtagtcccagctactcaggaggctgaggcaggagaatcgcttgaacccaagaggcagagggtgcagtgagccaagatggcaccattgcactccagcctgggcaacagaggaaaaaaaaaagaaccttcccagaagcctccaggaagtctctgtttggacgacatcgcacacccattcttgaaccaactatttagaagggagatgcatcaccccctttgcctggagctagggggtgggtcagcttcctacaggcacaggactatgtggtcgcgggttaagcccctaaacgaggggaagtggggtgggcagcagccgatctccattacaagggacaagagtaggggcagcaaggccagatcaatggttgctgaggtggctggggatggagagaggatggtggtggtagaagagatggtaacaatggtcaggtcctggctgttccagaggtgatgatggttggatatgcagtgaggaaaagacaggaatgaacatttatcttttcccaagttgtccttgctttcttcctttgaagccataaaaaggaaaaaaagggtggatctggacttgggagctgggcaggagtgagggaagagaagcagagcaagcaggcacaccaggctgtgactctgcaggcatctctctgcctagacttgtctgtatgatgtggaacgaacacgacccatctttactgctagcgactgcagcagataaggcaaggccactttcacgcagttaggttaataggaggctgtacaaagggctgtaggaggaagtgggcacaggagttctaaaataattggaacggccaggtgtggtagctcacacctgtaatcctagcacttcagggaatccaagacaggaggttagctaagacaggaggctcgcttaatgtcaagaccagcctgggcaacatagggagaccccgcctctacaaaaaatagaaaaattaacaggatgtgttggtgcgggccagtggtcccagctactcctgaggctgaggtgggaagatcgcttgagtctaggagtttgaggctgcagtgagaaatgatggcactactgcactccagcccgggcgacagaccaagactcagtctcttaaaaaaaaaaaaaaaaaaaagaaaagtgggggcaaagttatccttggaaaatttcttagtccattcatagcagcatattaaaattagtacagtagcttaatttatataagagaaaatacaatgtgtacagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtaactagcagccccgcgccgcttccgcctccgcccgccgggctgcccctgcctgtgctctgggccgccgccccgcgtggcctaggcccagctgcccgggcccccggagggaacggggataaacttttgtcacgtgcttctgttgtctttgtctgcagccctttgacttcgcagcggagtgaggggtgtgcagcccgttcgcctgcccaggaaagggggcttctgagctgaaggcgtgcggcagcgcgtgggaatttgggggcgggggcagcacgctgtcaacggaagcgttcgccttaatatttgtagcttgtaatgacctaaacattgcttaaaatgtgtactgtttgttgctctttgattgcacggaaaagttttaccgcgtttgtcatgataatgcttcctgtgcaatatttggttatttaatatttgtcacaatataatgccatttaaacattaaaaaaaaaagagagtctcactatgttgcccaggctaatctcgaacttctggcctcaagcgatcctccccctcctacccttccccacctcgcctcccaaagtgttgggattataggcctgagtcaccgcacccggctcatttttacaaattttaatttcatcgtataataaatgagttttaaactactggtgaaaagggtacaaagttttgtgtttcctagtgggactttatataaagaagtattcccaatttaagaaatagttttattgttaaatctgatttttctgtggattctgtggtctttcagattgattctgtcccctcaagtgtcttgaaattgttactttgaaaagcagtatttaatttgcttaaaatattttatgtcatgtttggaagagcatggattataaagggttaggaagttgcttcaacactataagcagtttaaaagttcttaactttttaattgaacattcctgtataagaacgactgtttacatagatacaaaaatatactcagttctactagatgggggttttgatagaacttaaaaaaccctcgtttgcttggaaaccacctgttgggatgaactgcgggaatctttctttgttctggttggtttaaattattttgtgggttggattttcatttctcagccatttttctctaataacgcaactgttaggtttggaagccatgttttcaagatgaaggtttaaaaatccagtggctagggtggtgactcaaacctgtaatcccagctgcttgggatgtcaaggtcgtggaattgcttgaagccaaggagttcgagatcagcctgggcaacacagggagacctccgtctatacaaaaaaatacaaaaaattagccgggccatggtggtgcacgcttgtagtcccacgtacttgggaggctgaggtgagaggatcacttgagctcaggcgtttgaggctgcagtgggccatggtcatgcaactgcacttcaccctgggcgacagagtgagaccctgtcattcatatatatatatatatatatatatatatatatatatatatatatatatatataaaacttaactagtttggcgtctttaaattagaagacattaatgtatttttttaaaagagaaagatagaaaaagaagaaagaaaaaacagcccctcatgaaatcttactccttttgccaaaacttggcattttttattctttcagagaatgtgacacagaccctcagaggatggtgtttctattgcctttcctctgctgcagtgggttaatttcacctccttcagtgtataatacgtgcataatgctgacttgatatgttttctgccatttggcatattaaaaagatatccttagttttattctgatgttagtgtgactgaaatgcaaaggatactttttggggtgctctgaacagctttctggtatcgtgttgagttacattggaagagagagtaactgctttttcagttacagtcttgtggcaaactgaatgactgttttctgtagacattgactgtgctaccaaattatttttctgtgttgtgttaatgttaattcggcacacaaaataaccacgtatatctgtcatgggtgtgtaaaattatccccagttcaggaaaaagcgcgtcagtatttaatctatctttatttaatagaagcatttgcttcagtggacaggagacccacaaggccacaaaataaactgattagatagctgcactgtaattatagtgtagtacaggaaaactacccagtaaatcggcagtgaaaattttttgtgaagcaatttatttaggctttaaagctggcccagttgtgggagtacagtgagttctagtaaagtagaagcgtagtgacatcctgagtgtagaaggggaaaatgtcatagtagcttcatatgtggcacttagtattcctttatgaaagatgaatcaaacatgcttttaagctcttggcctttccctacatgggttttgtgagacagagttaaactctgcagaaaatgatttgaatgactgttctcagttttccctgagagggtacctacctagttggctgtagatgcagagagagaaatgagttccttacacacagtgggtgccttaggcttagggcataatcttctctgggagccttgattgagaggggctggtaggtaatgtggcttaaatgttgctcattagttttgctctttctttttttccaaattcagctaaggagtataacaagttttacgctctctctctctttttttcttgtatgttctctggaacatggaataaaaaggacaaaaaattggcaacctgaggaagaggacagacaaggggcatgaacaagccacaacctctaagtgacaatatctgtagtcagcggttaggatcaaatattttaacattgctttcacttacagtcaatggtgaaacatttccaaaacaatttattttagttagaacttcggtttgtttctattttgatctagcaataaaacatgtaagaaacattccctgcagctttgtttataaagagaaaaactaaaagtctgacattgggggattggttaaataaatcaggagctgttacgtaggcattgaaaactaggacagtatgtatagggtggttccagttacgtttatataaatatttacacattttacataggaaaacaccattgttttaaaagtacacaattttattattttacctaaaagtttgtaaaattggatgggatttttttttttccaaaaaaagctattgataaaacttattttaattttaacgaaaattggaatgttactttaattgcaaaacactttctgagcctgaaaaatggctcttggctggtttgaatgccggttaggcaggtttatttcttggttacttcagagctgatatatataatttattcaaacaaccatcttccagttgatttccttcccccccccaaaggttttatttaatcttcatttgttataagatacagggagaggagagaaattcagatcatcctttttttgtctttaactaaatctgtttttactaacagcagtaaaatatttgttggaaaaatggaagcttaacctgtctagactgtgacctataccataaaatgtgtggtctaggactgttgtggagtgtcttgggctgttcagggaggtttccttgtactaagatcttgttaaatctgattctaagaattgcattatgttgaaatttttgtttcttggctaaggtgatgtttctgagatacctgtattttatctctagatactattagcttttattagcagaactactgagattttattgtaatattttaaaaagtggtggatccagtatcgtttttataggcttatttgcaggataatagtaagattagaaaattcattaggataatatatttataattgagtgcctcatgtagttctcacttggaattttggaatagcttatacttcctgatatagatccttggggaattaaatgcattaagagtaaatattttaaattttttataaagcagaacagctaatttaacttaatggagggttttcatatttcttgtgataaactaaactgcacatagtttaaagaactgtcagccacgtaggccatataacagctattctttccaagcctagaatccatgccatagaatttatgtaacaaatatttaatgagtatctactacatgccaggcatgttctgctgagtgtgcagtaatgaacaaaatacagcaagttctttctttcatggttacactctaggggtgaaggcatgcagttacatagccttaccttgggtgtttggtaggtaaggctaagtagaaaaacaggaaggtaagaggcgtgtagagaatgagggatgtgagtggagggatggtgtcttctgtaagccatcagagagggcttctctgttaggttccatttgagcagaaacttgaaataagtggggagtgagctgtgtggatatatggaggatattttagagaagagctttctagccagtatgagagcagtaccagatcattgtaagagttttggttttcatatttgtgagatgggaaacgattggaatgtgttttgaggctgatcttaaattatatccatttgtcatgcatatgtgaagaaatggacggatggaattacattatagggagcaactctgtgtgccacgcattgtgatagatgtttacagatccgatcttagaattttcattaatactgtttatttttcagatgaacagtttgtttctagtttttgcctggaactttctcatggcgtgtttgtgtcttcagttccacttagaatgctttttctaaggtggttataccagtttaccgcttgctagcagtggacagaagttctccctgcttcagtctttaccaccatgtgtcttttcatatttgctagccaatctagtgatgagtaatgaggttgatgaccttttcagatgtttattggctacttggatttttgtgttttgtttttgtgaaatacctgctcatctgttaactactttctattgggatgttagttatattctaattgattcatagtaatgactgcctttccaattatatattgtaagtttcttccctggtctgtggcttgacttggagcacttacagtggtgtctgtcctttgatcaacagacatttttaattttaacaattgtttccttcatggttagtgttttttgtcttatttttaagaggtctttcttactacttttctgaagatatcctcttatattgtctaatagaagctttactgctttgcttttcacattgagaatctacattctacctggaattggctttgtatatgggggagattgaggtcaggtttcatttttactgtatggatacctagttgtcccatcagcatttattggaaagagtgtcatgtctccaccgcattgtcatctttgtcataaatcaggtgactgtgtaagtagatcagtttcttgactgttctgttggcttgtctgttcttgcagcaaacctacactgtctaaatcattatgactttgtgttatcttggtacctggtacatggtggtgtagttttagttgtggttcctcaagattgcctttattttctcctttccagtccgtatgctgtttctttctttttcttgcttttgatactggccagttcaagtgctggtagtgggcatcaggggtcaacttttaaacatttaccattaagtgtggtatttactgtgagtaatttttgtatttgcttttatcagattaaggaaatttccttatattccaagtttgctatgagtttttatgagtgggtgttgaattttagaaatgctttttctaaattgatttaattatggtaatttattgaaaagagtatatttgttctgtaagttctgtaacttcaataagtaatgttgaagttacttttttttgccttcaagcatctgtttaacaaagcacatcttgcaccacccttaatccatttaaccctgagtggacacagcacatgtttcagagagcacggggctgggggtaaggttatagattaacagcatcccaaggcagaagaatttttcttagtacagaacaaaatgtagtctcctatgtctacttctttccacacagacagcaacaatccgattcctttatcttttccccacatttcccccttttctattcgacaaaaccgccatcgtcatcatggcctgttctcagtgagctgttgggtacacctgccacacggggtggcggccaggcagagggagtcctcacttcccagaaggggcggccgggcagaggcaccccccacctcccagacgggaccgcggccgggcggaggcgccccccacctcccggacggggcggctggccaggcgggggctgccccccgcctccctcccggacggggcagctggccgggcgggggctgccccccgcctcccggacggggcttctgccgggcggagacgctcctcacttcccagacggggcagctgccgggcggaggggctcctcacctcccagatggggcggctgtggggcagagggggctcctgacttcccagatggggcggctgccgggcggaggggctcctcacttttcagacggggcggccgggcagagacgctcctcatctcccagacggggtcgtggccgggcagaggcgctccccacatcccagacggggcggcggggcggaggtgctccccacatctcagacgatgggcggctgggcagagacgctcctcacttcctagacgggatggcggccgggaagaggcgctccccacttcccagactgggcagccgggcagaggggctcctcacatcccagacgatgggcggccaggcagagacactcctcacttcccagacggggtggtggctgggcagaggctgcaatctcggcactttgggaggtcaaggcaggcggctgggaggtggaggttgtagccagccgagatcacgccactgcactccagcctgggcaacattgagcactgagtgaacgagactccgtctgcaatcccggcacgtcggggggccaaggctggcagatcactcgcggttaggagctggagaccagcccggccaacacagcgaaaccctgtctccaccaaaaaaatacgaaaaccactcaggcgtggcggcgcgcgcctgcaatcccaggcactctgcaggctgaggcaggagaatcaggcagggaggttgcagtgagccgagatggcggcagtacagtccagcttcggcttggcatcagagggagaccatggagacagagggagagggagactgtggggagacgggagggggagggggagggagaggttacttattttttaagaaaggcacagttgtaagaatatgtttgcttgtatagccgaaggcacattccgttttgtaggtaggtgagttttcagaactcattacttgtaagttttattttagataaacttcttgttgttggcacttagtattgtgccagtaatgtgccataagaagagacaactttggttttagttctttggaagttgtcaataaacataaaacagtatttcaaggaggaaaaaacccatttcattgttttaggcttctctagattggaagaaaagatggtaatggtcccaaaacactggggggaaagggggaagaaggtgcgtggaatctgtgatttggccataactgctttattttgttttacctgttgttatcatttttagtttaagaaccttttagcttgtatcacttgcccttatctccagagtgatgtctcaatctttttagtctgtcatatgcaattttccccccttaaactacaactgtttatttgaaaaattataaaagtacaggaaaggtgaaagaacaatatgatgaccactgtttagagtaatcagttagcattttgtcctatttgcttttctctttatatattccttttttttcccttttccccctgcagaaccattcaaaagtgaattgcagacatcatcacatcaataatactgaagcacttatcattttacatcaaggtcattcttctacataaccatatctttttttacactcaagaaattaacattgacatgtaccatattcacattttctcagtttttctaaaaatgtcctttataactctctttcaatgcaagagccaatcagagattactatggcatttgactctcttagctccttaatcttctttcatctaaaattattccccgccaccttctgtctttatgaaattggcatttttgaagcgttagatcagttttcttgtagaacgtcccacaatttggagatgtctaatgaacataatcatgaagaaacaaacatttttggcaagaatactacgtagatagctggttggtggcacaagcctatagtcccagttactccaaaagctccgaaggctgaggcaggaggtggagtccagcctgggcaacaaagtggtaaggtcctgtctctaaaaacacacacacacatacacgcgtgattacatagatgatgatgactttccattgcatcacatcaggagacacataatgtcatttttgtcccattattagtgttgctaaccacttgtttaagatgtcaagtctctccatcataaagttacctttaaatggtatagtacttgaagacagtgtaaatatcctattcctcaaaagccttttgccatggatgatccttgcctaaatcagttatattggtgtttgctaattagtgattttctaacaatgtatttattagtttatgtttttcgagcaacaagaactctagcacccccccctttagtttcacaataaactcatttttttgttgtttcaagttgagagtgatgtgatttcttcattccttttgatgttcaaattgttctaaatttggccaatgggagccccttcaagctggctcaagcatgcattctttttttttttttttgagacagagtttcttgttgcctaggctggagtgcggtggcacgatcttggctcactgcaacctccgcctcctgggttcgagtgactctcctgcctcagcctcccaagtagctgggattacaggcctctgccaccacgcccagctacttttttgtatttttagtagagacgaggtttcaccatgttggccaggctggtctcgatctcctgacctcaggtgatccacctgccttggcctcccaaagtgctgggattacaggcgtgagccaccgtgcctggcttgtgcattcttttttcattatttgatcgttaccttgctttctggcacaggatgttccaggcttgccctgtagtttgccttagtcctgaaattgactgtttcttccaagagccttataaaataagaaatgcttagaaaccaagatatggacacaagtagtgctgattgctgctggggtgttaattgcatcaagcagacagtactaaggaaatatattaaccttcaatataccagaaaaagcagtcatcaccatttaccatctaggtccagtggatcctgtttactgtttatatttttaagtaatttttgcaaataatttacaggtctaagaataagggttagtgaaaaacaattttattggaaagtttaatcagaatttaaacacagcagttctctttatattaagcaaatcttgatgcacaaagattataagagatttaagaatactgccacatgtcctcttagaacaatgagattatccaggttcttgcatcatgaagtctttcctgttgaatgactgactggatgggaatatcctatttcctttttgttcttacaagtatagtgttcactcacggattcttaatttttccttattctaatcagtcaactcttttttaacattcactaagttcagatgcatgtagttttcttcctccattggcatggtttcttctaggacttaaaacaatacaaagataaaccattacagaatgcctgctttaagaacctatttctggtgtcttcagggtttttttctcctagcctctgacctcaagaatttaaaaaacttacaggagtagaagaggaaatagagtttagagatcttttattctagcaatcttgttttattatggtaaactaaatatatttaataaaatctgccatttaacatttcttgtgtgtatacttttcagtgacattgattacattcactgttaggtaaccatcactattctttctaaaactttttcgtcaccccaaacagaaactctctacccattaagcaataacgctgtcattctcccctcccccaaaccccaagtcatttatgactatacattttgttgcttgtgttttttggtgtcatatctaagaatccattgccagatccaaggtcttgaagatttatacctatgtttccttctagggatttcatgattttagcgcttatatttaggtcattgatccgttttgagttaatttctgtatattcattgattgttgattttgagaaaattcatctaggatattttcatctgaaggctcataatctgagatttaatttatgctctcatttcaccatcacgagtgtctttctgcgctaaccaatgtggtagccattaaccacatgtggctattatacttaaattcaaaattcaaattaattaaaattaagtaaaataaaaattcagttttttggttacaatggccacatctcaagtgctcattagtcacatttggctattgactgttgtattggtctgtgctgatgaagattcccttcatcaaaaaaaaaatttattggacttcattggtcaagagtgctactagctctttatattcataatctgattcatttaataattgtgaagtatctttccatcacttttttcctctttccattataggcagaaagtaaaaacaatctgaattctcaactgtgtttattgaaagcgaaaagcagagtacaaagatggtgtctgttatcatttatactgtcttgaaagatgatgcaatatcctaggcaatgcagtagacaatggaaggatgatattttgctgttgattgcattatccttctgagtgattccataattcttccattttctcattttcttattagttttttttttttagagcgtagttaggaatagttgatcataaaataattactaaggtgatgatgaaatggcaagatgcaggaaaaacataatcactaggatcctgtagtgtatcttagacttacaaagccactgtattcatatggtaattgcagaataaaatgagttttttttttcttaataggaaaattttcttttgattccttggaaggcctctaagagaagataaaaggcatgaaatattaatccttgcaaatagttagaactactcaagaaagaaactaaaaaaataaaactgggttcaatggaccctgactgtataccctgatactttgaattcaaatccattaccacaaggttcttcttaaattttccccagtctatatttgaaactccccttctttcatagtgaaaaccttggttctcaacatctgcatttattcatttgctctatcctacaatatatacaaaatagcttcagaattactgcattaataccactgccaatggcaaacctgaagtaaagttcaaaatgtctttgcagtttcattggcttttgtgtaattaatgcttttggggtgtacagttagggtactgatcccaaaagtcacttgaattactttttttctgtgcagttataccttggatttttatttatattgaatcttagtatttgttttttatctttttcacttaattgcattttatgaatacatgaaaacatttgcatggttcaaaatcacaactaaatcaaaagttatccctactgaggtaattctgattcattcccattcctgctcttacttacccctacagataaacttttttttttttttttttttgagacagagtttcactcttgttgcccaggctggagtgcagtggcgcaatctcggctcactgcaacctccacatcccaggttcaagcaattctcctgcctcagcctcccaagtaactggaattacaggcgcccaccaccatgcccggctaatttaaaaaatatttttagtagaaatggagtttgaccatgttcgccagggtggtttcaaactcctgacctcaggtgatctgcccgcctcagcctcccaaagtgctaggattacaggtgtgaaccaccacagccggcctagataaccatttacattcacttttgacctgtccttcctctgtttcttcttcaaaaatacatgtgttcactttatctcccctccatactgctttcttatacaaaaggcagcttattttgccttttgttcatctcattaaatgataaacctgggaattactctggttcatagagatattcctcatcattttttttttatttttttggagatggagtctcgctctgttgctcaggctggagtgcagcggtgcattctcggctccgcctcccgggttcatgctattctcctgcctcagccaagctaattttttttttttttttaattttttagtagagacggggtttcactgtgttagccaggatggtctcgatctcctgacctcgtgatccgcctgcctcggcctcccaaagtgctgagattacaggcgtgagccaccgtgcccggcctccttatcatattttgtggttgcatagtgctttatgtctgtgtcatcagatattcagctgatatcttattgatgggcatttggtgttttttagtctcttgatagtatagataatgcctcagtaaatcactttatgcatatgttgtttctcatttgtgaagtaactttgggtaaagtcctagagttggattactgagtcaaagggtaaatttgtttagctttatccatatttataaccaccctctcaatgaactattatgtttaatttaatttataatgtgaaataaaaatacataagagaaatagaagaatattatatctgaaaactaggaattccttgaattggctgtttcctgtgatcttcattgccattttcccagttaccatttttttcttttctttttttttttctttcttcctgggttcaagtgattctcctgcctcagcctcccaagtagctgggattaacaggcacccaccaccgtgcccagctaatttttatatttttagttgagacaggatttcaccatgttgaccaggcaggtctcaaactcctgacctcaggtgatgtgccctccttggccccccaaagtgctgggattacaggcgtgagccaccgtgcctggcccagttatcatttcttacaaaagaggcagtaattcctggctggccttggtagttccactttgttcctcttctgtctatttcccagagtagtctttttttttttttattttttgagatggagtttcgctcttgttgcccaggctggagtgcaatggagtggtcttggctcattgcaacctccacatcctgggttcaagcgattctcctgcctcagcctcccatgttgctgggattacaggtgcccgccaccacacccagctaatttttgtatttttagtagagatgagcgccatgttggtcagtctggtctcaaactcctgacctcaggtgatccacctgtcttcggcctcccaaaattttacaggcatgagccacggcgcctggcccagagtagtcttttttttttttttttttttaagaaggtccaaatcaataggtcttttattgcatcattgaaatatcacaagtatgtcttaggagtcatctggcatcttctttctgtagctggataactcttagatctgattcatcaacctgctgaacagttcctttttcagagacatagataccatccaaaaatttcctgatatccttgtttttaactgttgtgggttgctgaatcaaagctgctgaatttgaaacaagctcagtgtcatttccttcaaggattaattcatctttctgggcttgaggtactgaacaggcaacacctggtctcatctgaaccctgcggatgtatttttcacccaagaaatttcggatttcaacaagagacccattctggataacgacgttgatgggggaagtgagcatacacagacctcatcttgtaatggaagcccagtgtaacacccttgatcatgttctgtacatgactacaaatagtccgaacggtagccagttcctttctgttacccgaccatttgtcaacccggagcctcttttttttctttccaaggagtctgagttctacgttgatgtgattgaagtccttccgcagggttcctctggggccctttatgataactgtgcgtcccttcagagtaacgttgacattttctggaatgtcaacagtctgattgctgagaatggtcttcattctcacagtaaacgcagcaaaaaaaagtggcccagagtagtctttttaagaatgcaaattggatgatgtcattttgtcattttcctgcttataattcttttggatttatcagcaggaaaaccgtaaaagaaatacaatttatgttttgaaattttaaaatggattccaagtttctgttgacatctgcaacttttcttctgttttcatgaatgtattaatcataaagtctattatattttataaatgcaatatgtcaatcaaatgaaggtctgcttttattccttccccttggtttctttatagccgcttttgtttttatagattgccttgtaccttgtaattttgaactggatgccagatattgtaacaaaaaattctagggattctggagggggttaagctttcttttagcagccagagtaatccttatggagtatgttgtctgtttcataaattatgtgattatttgtgtgtagctctgtttctctattctgttccattggattatttgcctgtaattgcaccagtatcacactcttactattttagctttataataggtcttgatatctagtagtaaaattcctctagcactttgttcttcaagattgtctttactattctgaccctttgcttttttgtatatattttaggatcacctttccaatactcaaaaaataacattactggggttttgcttggagtgcactggatctaaagatcggtttgaggagaattaagatgtttacaatattaagttttaaaatctatgaacatggtatatcaatttatttacttctataactttttagtattagcttttaaaagtatataaatcttcatgtgttagatttatttctagatactattttttgttgccttttgtaatttacttgctattcatttttttttttttttttgctggtaacatacttgatttttacatattgactttgttctaaaattttttgttgttgttaaaaaatagagatgagtttgctgtgttggccagactagtctccaactccaggcctcaagtgatccacccgcctctgcttcccaaagtgctgggaccacaacaagtgtgagccaccatgcctggcctaaatttatttgaattctaattacttgcctgtacattctgatagtatctgtgtagttacatacaggcatgttgtttgtaaatactgacagttttattcattccagttcttaagtttttttttatggttgtttgttttgttttgttttttgccctattgtatgggctagaacctttaatataatgtaaaataaaagttaggacattgggctttacataccaggagggcagttttaagtatttcaccatacagatgttcgtagttggctttttgtagctactcgttatgaaaataaggacattttctcctgttgctaattttatcattaatggatgctgaattttatcaaatgtattttctatgtttcttgagataacaatatggtaaattactttgattctttaaaaatattcaaatgccattgcattcctgcagcaaacccatttgtagaggatgtgtttaccttgttgtatattgctagattaaatttgataatattttattaaggtattttgttctgttacatgaggcaaaattctgtaattctttcttttcttttcttttttctttttttttgattaactctaccagggtgctgcggctcacacctgtaatcccagcactttgggaagctgaggtgggcggatcacgtgaggtcaggggtttgagatcagcctggccaacatggtgaaaccccatctctacaaaaaatacaaaaataagctgggtgtggtggcgggggcctgtaatcccagctactcggaaggttgaggcatgagaattgcttgaacccgggaggtggaggttgcagtgagttgagatcacgccactgcactccagcctgggcaagtgagactccgtctcaaaaaaaaaacaacaaaaaacattaacactaccttaaacctatgattttcttttcttgtaatgtcgacgtaaggatttggcttcagaattaggctggtctcatgaaacaactcccatttttgtatatcctataaaagtttatacactgttgttattggtttttgtgtgtgtgttttgtttttgtttttttgaaacagaatctcgctctcatccaggctggagtgcagtggccaatcctggctcattgcatcctggaactcccaggctcaggtgatcctctcgcctcagtctccccgagtagctggggctataggaatgcgccaccatgcctggctaatttttctgtattttttgtagagacagagtctcactatgttgcccaggctggtcttgaacttctgggatcaagctatccatctgccttggcttcccaaaatgatggactacaggctagtcagccactgtgcctggctcgtactgtttctaacttaaatgtttggaagagttcatcaacaaagccgtctgggcccaatatttttcttggacattttgtatggagattttaagatacgacctcaatttctttgaaagttcaaagactatccagattttctgtttctagttatatcattttagaaaatgtgattttcaaggaattgtcctttctaagttttcaagcttgttgtccctccgagttatcataatatcctgttatctttttattatcagtagatttggtggtgatgtcctctttttaattactgtaatttttaatttgtgggttttttcctcccttgatttctcttcttaagggtttatcaattttatattttatatttttgcctttgatttttttcctcttttctaagtctgctttctactttactgatttcttctctcttttttcctgtttaagattttcctttgcctgtaatttttctagcccttagagatgatggttgaggttactaatattaacctttccttattataagatatgcattttgagctttaaatttttctcttaatcattgccttaggtactgcacacattttgtatgtcattttccttatcagtcatttaaaaatagtttctaatttctattgtgatttgctcattgacccataaattggaaatacattccttttcaaacattattttctacttatttttctgtttctctagtgtggtcagagtacacattctgcataattgaaatttaagtcttgccttttgacctaatgttttctttttcttggtaaatttttcataatttacttggaaaaaaatgttaatcctgcagtttttgggttcagtatgtgtctgttagttcaggctgcttgaatatgttgttccagtattttatgtccttgttaatttttttgtctgctaattctatcatttattgagatatgtattaaaatagtcactaggattatagatttatttttctctctttttttaacctttgctttatatattttacagctatgttattcattgtatacaaatttaaaattgtaaaaacttcctggtcagttgaccttttcaccattctgagatatttttatctctagtaatgctacttgccttcaagtctcctttgttggatattagtattagtatggtcacaccagctaaatttgtttgttttgtctatctttaaaaaaaatcttcttaacttcagtcttttgggttcgaagtgtgtcttataaacagcatattgttgtggttttaatattcagtctagatatcttttccttttatttagagtattttaagccattatatgtagtaggattcctgatatatttaattttatcacctttctattagacgtacattgtatttattttttattcaaaaaattgtagtaaatataacaaaatttaccattttaataattttattttaagagactgtgtcttgctttgtcacccaggctggagtgcagtggtatggtcatagctcactgcaaccttgaactcctgagctcaagtgatcctgcctgagtctcctgagtagctgggactacaggtgcatgccattgggcctagctaattaaaaaaaaaaatttttttttttgtatagacagggactcactatgttgcccagggtggtctcgaactcctggcctcaagcggtcgtcctgccttggcctctcaaagtgctgggaaataggcatgagctaccatgaccagcccattttaatcatttttaagtatacagttcagtggcattgggtatattcacgttgttgatcaaccgtaattaccatccatctccaggcctttttttttttttttttttaaatcttgcaaaactgaaactctgttcattaaacaataactctctattcttccccttcctgatctggctgccagcattctattatactttttgtctctatgaatttgattactctaagtacctttaagtggaatcatagagtatttgtccttttgtgattgggttatttcacttaccataatgtctcaaggttcgtccacgttgtggcacatatcagaatttcttcctttttaaggctgaataatattccattgtattatagaatgtattatgcagtgtattatacgtttttgtttattttagcatccatggatacttgggttgcctctaccttatggtgattttgagtaatgctgctgtgaacatgggtgtttggtttaagtatctgcttttgattcttttttttttgtttttttttttttttgttgtttgttttgagatggagtttcactcttgttgcccaggctggagtgcaatggcacaatctcggctcactgcaacctctatctcctgggttcaagtgattctcctgcctcagcctcccaagtagctgagattacaggcatgcaccaccacccctggctaattttttgtgtttagtagagttggggtttcaccatgttggtcaggctggtctcgaactcctgacctcgggtgatccacccacctcggcctcccaaagtgctgggattacaggcgtgtgccactgcgcccggctgctttcgattcttctgggtatgctcagaggtggaatttctggatcatatggtaattctgtgtttaatttttaaggaactgccacactgctttctccggtgactgtaccattttacattcccggacaaattcacaagggttccagtccacatactgggcaacttttggcatttgcattggctgtttttgttttctgtaaggaccatcctcattactggagtgtcaaatggttccccattatagttctaattgatgtacttttatgttcttttttctctgctttttttttttccttcctttggatcaaacattttgtattgttatttcctcctattaacttgtttgtgatacattattttttactacttttatactgtacttatggtttagtactaaatataatatgtatttatagtatctttttttttttttttttttacaattccttttcactaagtaagtctctggtgtctctagagatcatagcattcattcatttatccagcccacctcttgcatgattgctcccatgcattttaattctacgtattttaaacaccacaacactgtatttaattgttctgtgtggtcaatattgatttatctttacccatctttttttttttttatcctgtacctttactcttcaattctttctgcatttatattactctgaagagtcctttttgttgttgttgctgtcttttttttaaccgatcacacttatttaataacaatatctagtttaataatttttttgataagacattttattaacaacatgtctagtttaataaaccgtatttcttttaatgaaagtctgctggtgcagaattctgtttctgttgaaaatgttattttttccttcatgttggaggatctatttgctgtgtatgtcactatagattttcagttattttttccagcatttcaagatactctgttatctttcactttctgtcattgatgttgaagttagctctagctctaagtcttgtcactcctttgaaggctgtgaatctcccctgtgcctcctccgcctacccccagctgcacataaagttttccctttttctttggttttcatcactgttaactatgttgtgccttgaaattttctttgtgcttctcttgcttgggattcttggagtttcttcagtctatcggctgatactttgatatcagttttagaaaatccagaattcaagatcttttcaatattgcttctgctgcattctctcttccctttctggatcttgcacttacactgtgtttcacatgtctcttattggtcttttctgtattttccatgttttatttttgaatctctgggctttaatttggtgttttcttttgacctgtcaagttcaaaaatcctgatttctgctgtttaatcttcttttaatgccatttattttaatttttggttcttcagttgtacaattttcattggtttcttcctgtagatttcagttctctagtgaaaattgctatttttaaaatatattccttttatcttttcctctatttccttgaacatattaatcattatgtttgttaacaccagtatctagattgcatgtgtgtttggttctgttttatatattttttcttttgacttttggtcatatgatcctgtttcttggcatcctagttatttttgactaaatcctgggattgtgtctttaaagattgtagatattcctgaaggtgataacttcctctggaaaaggcgcgtcctttcttctactgaagcagatgcagtgggagctggtcaccttactccgggcaggtgctgggtggagtgaaggccaggttgttgttttagtaagccatctgctgcttctggtttcttcaggctttcatctggaagcttgattttgctcactacaccatatttccttggaggcttctgaactaatttttgtttgatcctgagctctgcttttcagagttttagtttatctttttggccttcgcagctcagaatttgacagataccatgggagggaaagcagttgtatgcttaagacctctcttgtgctctcattttactaccatatagccttgtcagactgcgcaagttctgcttgtttctttctgctagccatggctgtctcctcagggcccaacataattctcagcctcttgcctgtgcctcctgttgtctgagaaaaaagtggcttcagatgatcagctcacttctccacagttctcccctctctgaatccttggtccctcttgtcctcactgctttggcagctcttgggtgcctttaaagagataatttttgtatttatctgtctgtctcttctactttctgagagttacaagctttttttgtcctacttggaggtattacgcaagtctagactgagttttgaatttacatagctacttgcagtgatttagtgtgatttgagatttttactacagtctcactgacagtggtggtttcttttgtttttgttttttgttttgtttttttttttttttttgagacggagttttgctctcgttgcccaggctggagtgcaatggcgtgaccttggctcactgcaacctctgctttccgggtttgattttcctgcctcagcctcctgagtagctgggattacaggcgcctgccacaacgcctggccaattttttgtatttttcgtagagatagggcttcaccatcttggccaggctgatctcaaactcctgatcttaggtgatccacctgtctcggcctcccaaagtgctgggattacaggtgtgagccaccacacccggccagtggtgtttaaaataaaaatgtacttctttaattaatgctaaataagattgctttaatttgacttttttgttacctgggagtatattttcctgtttttttttttttttcttctacttgtatttactcttcagtggactgtttgtttcctttgagcctttcacaggcacattctcctcctaacctgtgtggcaagtttgctactctaaagttttcttagttgcaaatcatacagatgcttaggaaattatgaaataatttactgtaagaagtcaggagggagtcaagggtaggagttttttgggtctctgtgttttgttttcttgtacatttatgttgtttcctgtaccagctgctttagatggttggttagcttgtgcagatcctatagtggtctttcttttaggaccagaatctgtaatcacctcaggctctgatgtccaaagtaaatgaggttggtccagttagcagcaggtatctatcctctccctttattgtggctacagacggagaaatgggattctttacccattctttatgggagaagggcagggtttctacgaggaaggcatgtgaatggagaagaaatgattgataatctctgataaaacagtgggcatgcaaggtggaattcaggcagtatttcagattcagaaatgtaggtcacaatttcttatctgcagttcggaagcctgaaaagcactgaaaacacagttattcttaagtttatggcatattcattgttgacaaaactggaacttatatgggtgaggcatttattacattttgaatattcatatgtttcattgcaaatgttatgtttactacatggccctacctcatggagctttcagccagaacagttagagttcctggatctctagttcaagtcacccccaaaaccctccaaacatgtaaacgtcttcattcttagaagtattactgaatgtatgtgtcaccactcttaaaatatttccaataggagaaaactgtaatagaatacttaagatagtgagtaatgattactgaaagaaaaaaagagcccagtttgtaggtaaagccaacaagggagggagatgtatagtgccagagcacgttagacatagtccgatatttgtgtaaaacgagactagattggcatacaggaaaaaatgcttagaagcctgtgtaggaggaatctggctaaaacataaaggtaaagattaaggagacttttgattccatcttagctaacattttaaataagaacatgtaagtgttttcagaagtggctccatataattggacttagctttcattagcagttttgctttgcagcatatttggaacataatttgtttaaaattgaaatggttttctttacttttatggtggttgatttatttatttatttatttatttttggggacagggtctctgtctgtctcccaggctggagtgcagtggtgtgatctcggctcactgcaacctccacctccttggttcaagcaattcaagctacctgagtagctggaattacaggcatgcaccaccacacctggctaatttttgtatttttggtagagacggggtttcaccatgttggctaggctggtctgaactcctggcatcatgtgatctactggcctgggcctcaaagtgctaagattacaggcgtgagccactctgctcaggctatggtggtttttatacagcaacactcagtttattacagtttatcccagtgcttattgcatttttttctgttaggaacctgtagtcaattcctcccttatttgcaaaggggtttacttaaaagatttgtaatttttgtaaattttgttgaaagtacactatttgtatactttggtaatgatatttatacatctacttgacaaatctatcttttaagaaattattttcagcttttaagtaactgtcacataacatgtatgtccagtatccattggcttcagctcccactgatactattttctttttgactcagcagctttaaaaccaaaatagtaagatctgtcttgaagccacagtctagcaggagaagcaaactatataaatttagacagctctgattagcacagttcccaaactgttatattatgcattaacccatacaggaagaatttaaaattgcagtatggtgagacaagttttagaagtgaagcatttttgagaaaagtatcaaagatgaagaagtactcttgaccttttaggctttctgttccagtctagttttagtgtggcattgtatttaacttgccttagaaactcataggtttatgccctcttgtggtctgtcaccaatataaatagcacaaatgaaaattttaagtactggagatcttactgcatgttactgctctcctttataaaataatttttaaaaagcagcttctgaggaacaacagctaagaaattattattcctgtcttccatataatgtgtggagcttaaaagttaccaaatgttattttaacccttggtaacaaaatgtatgtgtatgttaggtggacactaatgaacagaaaaatatttttggatgggctgtccatcattgtccttctaggtgtctaaccctattaatttataagtgtcttaaaaatatgatgaggtgtgatagtaattgtagggctagcacattacccttctaccttcacctaaacatacacagatatactagtaaatgatgcttgggaaatgtgtttatacttgtttcatctgaaagggtcaggagctgtaggaggcattggaagaaataaggattataatgttagtgaattggtgaacttaagcttacagaatttgcttttactgacatgattggcaaggtcttatttgtgagtgtgggactgaggaactaactagtggaggagaaacagcaatagcagtcagtgttttaagactgcagctgtaaccagtgtttttctgctgttatccagtaagccgcatgatggttggaagcaggccagtatagggactgtgcactttaggattagatagaatccctgatagaaagacttggttttaaaactggtctcatctcttaccagttcctggacagttgtgtaatattaagtaagttacttcatctctgaatacaggtttcctctccaaataaagatttaaaccgcctccattgaactctttgcagttcgttttgtcacatgcagtgttggcatatactcctgttgttattgctcataggttaaagacagttttgtgttgcaaagaatggataccatatgactttgtagccactgggttgttggtaaagactcctaaatagtggtaaatcagctcatagttctttttctttactgtggacttactgctgtacttctatgtaggtacatactttattataaattcttgagtgtaaacgaggtcattatgttaaagaatttactagttcaggtattttaaagttgaagcctagtaactatttttaagaaaaatgaaaataatacaataagttttttttctttaggggcactatttgcatgttttggcaggtttaaaaaataaacaaaaactagttttgttcttccattgtggtcttacttttgtggaggacaacaaagtaatgaaatgtttttgtttcttttgctgtgtttttcaagtgttgcttgtagaacaaggctcgctgccttatggttacttttaaaatttaatacttaaagtaattaatctgagtcccctttcaggagaaataagattatttagaataatttaacttaagggaaaaatatttgtttttataacaccttctaaaatttctaagttgtagaaatttactaattttttcttttttttttttttttttttttttgagatggagtctccttctgttgtccaggctggagtgcagtggcgcgatctcggctcactgcaagctctgcctcccaggttcatgccattctcctacctcagcctcccgagtagccaggactacaggcacctgccaccatgcccggccatttttttgtatttttagtagagatggggtttcactgtgttagccaggatggtctcgatctcctgacctcgtgatccacccacctcagcctcccaaagtgctgggattacaggcgtgagccaccgcgtctgaccaaaatttactaattttttcttttgaataacttgctgtgaaatagaagacaactaaaaaaaaaaccctctaaatataatagaactgcttgggcttaaatcttttctgcaagtaggtggaccataaatcatataaacaaagataacctagacatgccatcagaaggctagtctatatatttttatatctacctctttcatctttccccttatttctgatttcccaaatgtcacttctttagtttacatttggatagtgcttatttgaagtctctgatattctacacactatatgtaactaataaagactttaaaatgtaaggcagcattttggtagtgaaaatttctcttgtacattgtgaaatggattttgttgttcgtctatcttcctagggagactgtttaagggaagtaaaaggaacagggcaagaatggccggaacgaagtggagggtagactatggggagtgatggcaagaacacatgccattctaccagtgacttgtttcttaaacataaaaagcatatgtgccaaatttgcatatttactaattaaaaaggcttcctggaaacattaggtagactatcttctataacctttaacaccgtcactaatggatatagcttagaagatttcctcgaaggtcctttaaataatgtaaatgattatgaatgtgtaactagttaatatgcagctacgaaaggattatcatgtagaggttaatgaacattctgctcttatggtttgcagggctttgctttctgtgcttttggctctcttcatgcttggaaacacatgcattgggattggaaaacatcctgactgttcttgggtctcatcttttaatggggttgttaaataggaactttatgaaaaggatttcatgagcatttttttcctttttcaatttacatttaattctatttgtctattttgtaattactgccaaatcagaaacagtgaaatggattgatgtagttttagcttggctcttccagatgtaaagtcagtactctattatatattgccactgttattaagtgttgctatgtgattgatacttactgagagatcttcattctaaaatggactttttatgctgagttaatgtgtagtatggttgggtttctgattatagcatgtattttggtacagaatttctgtcttagtatttaaaatgtcccaaaagaggacatttatttcaggaattaaatgttacaatagaggaatttagtgacaggtctaaaaaaaatcgtgtgtattttttttttttttttttttttttttttgctgggacgggatggtgaaacattgagcatatacaagagacaatattggtatttagagcagtgaactagagcagcgttttgcaaaccagataatgctgctctctttttctcatggcctagtcttaagcattttggctttcatcccctagtttctctgtctctaaaatggtatatggtattctagactgctgtttaaaatttttattaataggtaatttaaaagtagataattagcaatccttgaaaacagtgttaattcttaaattgtcattcaaaaatagtgttatttttttaaattgcatttttctttattgtctagtcttcttattttctgagcattttgagaatctactgacatatctccaaggaaaacaaataacttttgtacttaaattcattgttttagtattataaacatagtttaaactggctgtgaagtgcttacagtcttgatcataattcactggggaacaaatgagctgttcagagcatctccttatcccaagtatttcttcttgaaaatgtagtagaaaaatatcactgaattcattttttaatgcgtcagaataaaaattacaggtgaaaatgtttggagatatactgacaaaataaaatattgtcactacagtcattttttttaactgacgaaacgtggatgttacattggtttcttgttatttataacatttatgtattctacaaaatatgtaatattgaaaacaggtctgtagattgtacaaaatactagttatcttatatcatatgtcacctaatagttatgaagcgggttttgtaccaaagtatgaatcagaaagctgtaatttgttctgcagttatcagcctgcattagagggttatgataaagtgtgctgcttaaaaactaacgttcacatctctgtgcatttgacaaataaaaatgtatactgagatgctattaaatctgtaaagccaatgttctagttttcagatacactgatttttgtagctctgtgcatagctctgttttttcatgagtagttatctgttttcatgacaggtggtcactaactgccaagagagaatccagcattggtgagtgaaagatggttttattacacttctgaaatactgatggggtaacctacttgtgttcaaataatgtgtttactgtttgcgtgtgtgtgtatgtatgactagtaattgaattcttctagtagtctccattttgaatgcctttaatactaatttatattgtctttgacccttttctgaattacacatttctgatttcctgacgttgtgttaccacttgtatttattctaagtgccttttcttttctaagaataatattaatatcattatgaattggagactgagacatttttgaatgtgacttagctctattttggggatatttcttacattttagtagaaaaataatgggaatcagttactttaaaataatgatggaaatagggcacagaaatgttttcccaaagtttgaaaaaaaaatctaattttctacttttcagagcttgttttattgactgtactttttttttttttaagagagagcatatctattttaatgtgctaatctatagttaataggaccatgtttggtaaataacacactttcctttggcttctgaggaaaatgctcgatttaatggtgaataaaatcttatattatgagttgtcatgaagtatagctgttgatcttacagatatcaaattacaatatatccatgctgtgcttacgaaggttttactgagagaacaacaggagctgtcttgattattgtctgcagggttattgcaaaaatcatggtaactgcccctttagtggtgagattaaaccttcggttatacaccatcaagcatataatattttaaatttattttaagaggctttttcttcatgcctgagagatctccaaggaaataatttatagttagtgtatatcaaatgttttttggtttaaatgcacataggctgcaggcagtggataagagtgaaaattggtgcaatctgtacacatcatcttattaaattttgactattggcttgcagaaaataatctaaaactaataatatccactttataagtaaaaattcaggacttcattaattttcaataaatgcatcgttgtagttgcttccactggtggtgtaagtgtgttagcatttccataatggaccattcgcctttcattatacattcagttcaggttaaaacttgaaatacaagtcgttggccaaagaattttttcccctgcacatttagtcagagtggcccattttacaaataatttccagaggaagtttattaacgtggacttctgtctattggttttggtaagaagttcaggaaattagaaaggtattcactggaaatagatgctagtttacataaatgggtgaatggtaacttgcttctggtttgttttataagattcttattagagttctttaaggataagggcacgttttcatccttttattcacagcccctactgctatgtttggcacaaaataggcacttgataaatgtttgagtaaatgaccaaatatgtggttattttctatataacattttagtttacaaatactctagtagtgcacaagtctagtgagcagtgacagaaatgtgacatttacttcatggcaggttcatgtgaccctcaatttcacttttcagttttgtaaaaccctctaaactgtagaagcttagcatatttgcctacacatatcttgaagtaatatagtactttatacatttaaaaaattatttttttccagttaaaatttgcattttcctctgaatcatttctggtttggttcaggaaacagacttttctctttgcttttaatgaagatctatacatggtatattgctcaaatctgaatggccagtaaattaatcaattcattatatcaaaaaattgaaaccaaagtgtcaccatttccctgaaagcaaggaaattgctgtttgggagagtcgtggaattcttgtgatatttttgcattctcttaattcctcaaacaatagttgagtttctaccatatgccagtattgtgctgctgtttggaattgaaagaccctgccatagaagaattcatagccagacatataacagggaaatcacgataattttgtgctatttgcggagatatgaagcaactacaggagttcagaggctggagccgttcttagggtgtctcacacactacttttaaaagcatgttgctttaattcctacttaacccttggtattagcctagtctaaaatataatttctgttaagcccctattctttatgagtacgcaccagtatagtaaagaagaacaaaatatatggtttgaaaaatgcattcttatgctggtgatgtttatgcttgtttgtataatttttaagggattctttaaggaacaagtatatgtattctaggctcagaaataatctaaattggtttttgtttaaaaaaaaatgtaggacagggagtaaaaatatttatagaaaaataggagtgaaaatggtctgggaccacaggatctacccaaaaaaatctttgagaaaattaatttaaatcctagaactttggtgaacgaagaaatttataatatttgtttagttaataacagataaaaaggaaagattcaagcctattggatgagaatttgtacattattttagagctaataataatggttttcagtttagtgaggatttaaaaaatgtttttgaatcaaactttttttctttataatcctttttaactaactcaggaaataaggtattatgaaatccacacactgttacctccttaaagtatgaggatacttcccactgtttggtccactagtggctgattattttgtttgtggattatttgtaattttctttttaattcttccttaaagagcatggcatttggagtcacagacctatatttgaatcctgtcatttactagcgttttgaccttgaacaattatgctcagagtctcagttttttcttgtaaagtgatgatgatactacttaactcacagggttgtagtgaagatcaaatgagatcatgtctgtagaacaccctgcccggcactcaataagtattaataggaacccatatacctcttttgaaaattttaattgtcagacaaataaaaaaaaaagccagtgctttgtaaatattcgtgaatatttagtgttcattctgtttttttgtcatgatggagagagagttgggtttctgtgaattactgttacagctttacattaatatttttaaatcactttttggtatgaagaatttcaaatgaaaggtgatagagtagtatagtgaatcctcatgtactcatcagtcggctttgataatcatcaactcatgattttctctaaactgttcatttcaacatcttatcttgccatctactcctacctccaatttttttttaacttttattttagatttgggaggtacatgtagaggtttgttgcaaaggtgcattgcatgatgctgagatttgaggtacaattgaacccatcacccagatagcatagtacccagtaggcagttattcagcccttgcccctgccctttctcaccgctcttgtattccccagtgtttatttgttcccatctttatgtccatgtgtccccagtggttagctcccacttataagtgagaatatacagtatttggttttctgtttctgcattagttcgcttaggatagtggcctcctgctgcatccatgttactgcaaatatttcttcttttttatgggtgtgtagtagtccatagtatatatgtatcacatttttgttatccagttcactgttgatgggcacttggattgattccatggctttgctattgtgatcattgtggtagtgaacatacaggtgcatgtatctttttggcagaatgctttttttttttgggtggtctgtattcagtaatggattgctgggttgaatggttgttcagtttagttctttcagaaatctccaaactgctgtccacagtggctggacattcccactaacagtgtaaaagcattccttttctttgcagtcctgccaacatctgttcttttttgactttttaataaaaactattttgcctatcccatctccagttttgaaatgaatctaagccgtatcattccatctggaaatatttcagtatatatctttaagagacaagaaagactatatattaactttttaagatttaaataaaaaatatttaatgagacaatacatttacatgtttcaaaatttaggaggtatgaaaggatgtaaatgatgtataggttcctcctaactttgtcccctaattctcagttctgtttactttttttttttttttttttttgagatggagtctcactctgtcatccaggctagagtgcaatggcatggtttcggctcactgcaacttctgcctcgcgggttcaagctattctcctgactcagcctccgaagtagctgagattacaggcgcgtgccgccatgcccagctaatttttttagtattttagtaaagacggggtttcaccgtgttgcccaggctggtctcgaactcctgagctcaggcaatgcaccctcctccgcctcctaaagtgctaggattacaggtgtgagccaccgcacccggcccctcagttctgttttctggaaacagcagttttttaccaatttctcataaatcttttcagaaatggtttgcataatgtaagtgtttgtgtatgtatgtgtgtgtgttgtgtgtgtgtattcatctacatgtttatatacggctcccatccttttggacaaaaatgaaatcagattgtacctgttcatttaatactatacctaccctgtatcattaactaacagttcctctttacctcattccatacattttgctgtatgtcagacatttaacttttaggattactaaatgagacctggaactatttttttttaaataaataattgctacatgactgagagtatagctctgaactcaaaatatatccttgctaagatgatatatctgttattttactgctccttagtaaaattactgcaaaacttagtggcttgaaacaaccaccatttacttgcacatgattcagtgggtgtgcatattaagctgggctcacctgtgtggttcttctgctagtcttgtgtgggctcactgctttggttgcagccagttggtggctgggtcagctttgttgtccagaatgacctcaccctcaagtctggtggttagtgctgttggttgagcctctgcctccatgtgctcttttgtccagcttactttctatgggcatctcagcagcaagaatggaagctgcaaggccacgttatgttggtcaaaggaagggccagcgcagattcacaaggtgggaagataacacccacctgttgagaggaggcgtgaaaaagaattaatggtcatttttaatgcactgcaatgactttattgaataggtcctacacacacaaaaaggaagtctccgtcctttatgttgactggtgagaatgaaatgaaatagtacatgtgatgcctggcagttcatctttatgttaggcattacttacaatcgtaaatcgtatgcatgtgagttgtaaaaaatttattgccttgcttcctttattttaaaaggatttttggtaaaggtatctttgaaattacatgaaacagacttaaatatagaagaagatactttgttcaggtgtttaattttggaaagaatactttaaatttagacataaaagttctaaaacactttggcatgtgagttttgagagagtctaaagcaaatactcaacatttttttatttttcaaaggaaactggacaaaaataattgttcagaggaaaagagtaactagcttccattagaatttatagttaaagtatatagtaggaaataaccaagaaagcatacctgtatagctaaaaatctcaggtgaagatttgattttctctctctcttttttttttttcctgttggagctactctttcctatcagtcgggatggagatacctgctttatgcacacattgtatatctgtctatatgtctcatgtttttgaggcattccttgtgcacagaagcactgaactatatcattgtaacaatgccatggtttacagtatatttcatatgaatacctgaaactgttttcttgagttgccttcacatgctatataaaatttattttattatgtataatatgtgaaatattgatctgcatacctttaaaacttgtaaaagccaatgacttttttctacagtgttaggtagatttgtaaactgtgtttttcagagtctgtattttactgactacaaagttttcagtcactgttttgtagagggccttctgtttgggctttttctttatgttattttttctttttttttttttttttccctcctcttgagcagagagcaactgccaaactttctggaaattttgcatgtttttgttgttggagtttctgtagttgtttatgaaagtcttagggataagggggaagaatcatatatgtcaaatcttgtcattaagtttctgcacagttttaaaaaatggtgtgagttagtacatgcgctagtgattaagtgagtttggaactcgtgtgtaatgtttcaaagcaaattaagaggcaaaaaaaaagattcaagttgaatgtttaaagaattttttttaaatctgagttaggtttttaaatgtttattctgaatataaaatgaatgcatgcttagttatggaaaagttgaaataagaaaggaataaagataaatttactcataattgtaaagagaagctaattctctccctgtttttaaaacattcccttttattccctctagcttcttaattctgtatgtgtatttatgtgactaaggtcaaactgtaaatgcatttttcttttccttctctttttaaagagttaaatgatttttaacttgtaattagaatttattacttgtaggagtcctcaagcttttatatcatgtttttggaagcaaccagctagtttaacgcacttctgaaaatgaaaggaaaacttacatgttataggagagtttttttcccctgaagagttttaaactattattaaaaaaaatccctaatcacatttcatcacctagaatagtccttgatgacgacgtgtttccagtgtcaatatggtttggttcagtttcccatgaccagctcaagtccagtatctgactgaggcaaagggcttagggcttactgctttgggcacacctcatgattttttatctttgtctcaactgtattaggtttgaaaactgtacttctttgtacttttttttcattttccatttttttttatgaagagtaacatccaataaaactcttaagcacagagtcctgtttgaggatgaagatgtgaatattgcaacaaccacagtgcttgtctgagaagtgcatcacttggtgataatcctgagtgcttgttcttattttgagaaatataagtccagattccactataccaaagacagattggggtgggtatcagtgtaagacctgagagaaatgtaggctgtgaaaaatggaggcatgcctataatttactttttactaattcatattgaactcatgatcaaattggtgagggttttcacatttttcttttatttttaagtcagttgataattttgaggtttttaaatatttggtaggttcaaaaccaggattgccatttttcactgttgtaaaacctcttgagaaactttaacccggaggtatctatgattgggcctctgctgaaactatatgtaaaatatgagttcttttctcagggaagagcctagagtttttctagtttctcatagggatcagtgacctaaaagggttttttaattgctactgtaattaagaaaacccacaaaattacttttttctaaaatatgctttagaaagaaaatatagaaagtgtaaagtagcaaaacctatgaattacggtaagatttaagtagaaatttgcacaaactttcaaagcttaagtcagctataaactcatcacaccttttctaaaaggtcctttcctttgatttgtaataggaatttatattagttatagaaaatttggaaaataaaaagaacaaaaattacatataaactcatcagtaaaaattaactaggcactttaggatatttctttcaaacgtagatgaatgtgtttttacataattttaaaggttttttgctttgaattcacatctcattttcttagagcaaaagattagtaatgagtgaagaaacaggcacctgtgataactgacaagtcttcaaacacatgtgtatggttgttgtagagagaacagtagaacagatttttctgtccaggcttactatatatatatatccattgcactgttttctcattgttgaaaagttaaattgaagaaatctagtagaatgttagctgcatctctctttagataattttgtttcattgacttgaaaaattatgtttttatatgcgggttaatcttggtatctatgtctaatagtaaagttttctgatggactcataaaatataaagaacatagattatttcatcagcatcttctgatgacataaattccttggtataatagagttataaaaaaggaatataccaccattctgcctgaattttgtggtacatttcagttacttatatcaattgaaattactgaatattttgccatgaccatttagaaaaaaagtgtaatgctattgatttaattcaagtacatttaaattttccatgaggagtgttccttttcccaccaaattgcataaagcataacagtatagatccctttttcaagaatttttaaataaaatgtaacttttatcaatttgtttagattgtttaaaaggatactttgaaaaaaatcattatttcttgctttagtaactggaggacatctctttatctatatagaatccatgcccaaacttaatattcctctattttcttgattttagaggtgaaaagccaggcatccttcaagctagtggatctttgacaaagatgcattgcaaaacaatcaacaaacaatcagaaaggcatgctatgtgtgagtgatgatccctgcagcatatgccataggcttgttgtagaggagctgctcagtaaatggtggattcaattgaaacaagtcttttttggatgcttaatgggaagttgtagggtgggtatgatggactaaaaattatttctaaagaaggttatatattgtatatattccagaatcttccgtttttatcgtttcttaaattaaaaaataaaaatttaactctgtcccaggttaactcagatgttaacacttatatagaaatttttttcctctttccccgttaggcatctcacagtattttctgcttgtctgtttaggatgttaggtagaggaaaagagagtgatagaagattttttttcttaaaaaaaaaaaaaaaaaaaaaaaaaaactgggccaggcatggtggctcacacctgtaatcccagcactctgggaggccgaagcgggtagatcacaaggtcagggttcgagaccagcctgaccaacatggtgaaaccccgtctctactaaaaatacaaaaattagccgggtgcggtggcgcgtgcctataatctcagctactcaggaggctgaggcaggagaatcgcttgaacctgggaggtggaggttgcagtgagccgagatcacgccacggcactccaggctgggtgaaagagtgagactccatctccaaaaaaaaaaaaaaaaaaaaaagttcaatgttagtatttgctgtctattttaacttcttactttaaagtaaaattagcaaagtcttattgtttcaacctgatttaaattttatctcccttttttattatttaaaggttggagtctttatcactggcctcaaaggatgtagactttttttttttaatagagatttttatttttgtcagtcacttttaagaggattaaaaatgttgatccctttcatatttcctcgtccctttaaaaatattctattatgacaaatttcaaacatatggaagagtgaatcttgatcacctatctgtctgtaccctaatccgttaatccatttttttctgatgaatttcaaattaagttgtggacatctgtgtatttcacccctaaatacttgagcatatccctcatttaacttgatttctctcttactttctacaattttatgcaaatgagctgtttcccataggttctgtcttgatcttaatcctttaagggtaagggctaacttgtggttgtgttaatggtcttcatcgctgctgcctattttttttttttaatttccttaaaacaaaaggtactctcaaaaggcatattgcacatgattagcaagattcagaaggaagtggttaaagtttcttacatgccttatacctatgcttttagttcttgttttgtataaggaatgttgcatgaggatattggaaaaaaatttaaaattaagagttgaaggcggaacctgatctataaggatccattatgttgaagccaaagaagcaggtctagctattctaagtaagtaggctggagaggtgtttcttaactctatctgggttttgttttccatttgaagaaaaattattttaagcaattaccatttttgattactgtaatgactcctgtgtccaaaaattaattacgtttctaattattaaaatagaaaaaaaaatctgttcaaattttgttataaataaagaccccagacttaacctcagtaatgcattagttcttagcataacttttgcattttctgttgcataggctttgtgatctttaacaggattatttaagcctgaaataatagagatactatttggagatcactgtttgactaagccctgaacatttccacgaatgtagcctttagagagagagggttcctcaagctgtagtttcttccagagacattgcttgactcctcctggcctcccttcataaaggatttctacatgggctgcattttaagtgatcttctacttttgtatttttagaaaataattcaaaatttataaatagcaactctaatcttaaactgctctccagtatgtccgcatttttattccagagagaattattaataagttgaaaactgattatatttgacttgaaatattgacattgatctctggtattgcctgtttttgaacgtactgttcttttaatgtacaaaatagatgttttttgtgaggaagttgtttttttttctcctaagcattgttaccaaaataagacttattgaatggtgactttaatactagcttcttaatattcatagaaatatttagatatctaggctggtgtatttagtccttgagcatttgcagaattacttatctgaaacataaataagctgttagtgttatgttattaatagtgagtgttgactgtctaggcactgtaccagtcagtcctatggagacattctcccattgattgctcacaccagtcctgtttccaaagcccctgaatggttacattcagctgtactgtctttcagcaagttatactatttgtatcaaattggttagtgaaatcttgtaggtaatagtctttcttgaaagttttggaattgatgttttttgatgcttcatgaaaaaaatgagttttgagttttggaaccaaaatagtagttgctccatgctgggcagtgtgttagaccttttatatttaattctgttgaacctgtgagataagtattagtccaattttgccattgaagttactaagactaaggtgaatttgtgtaaattgcatgtagagcttgggattcactctctggtctgacttcaaagccatgttctttctggtacatagccttgtgcatgaagtttttttgccattttatccatataaaaattttccaggaggaggatttttgccttaaacaaaagaataaaacatgtttcgtatttatttatagaaaaggattttttttggggaaagttataaagcagttgcacactagaaaatgagaaagctttcatgaaggaatgcaggtcagaagacctagctaggttaaactcattgcttacctcatcttgatagaggagatctggcttcttgctatgtggtttttccatcttccttctactttgtcttctgtaagagaaaaatactgataagtgacatttattataggttatgtaaaataatatatatgtgaaattccttaagatcttaagactgagctaatttttttttattaattatgctactgttgcttcagggaactaagcagtaagctgaaaccaattctgtgatgtttgtcatttatattatctggagagttgttacctacattgcagtttatcctgatttcaatttgacaatgtctacatgttcttttaaattacttgctgagttggtgaatttttgtttctgttatttttaaaaactgacaacatccttctgcttaaaaaaaattcagtgctgtagttttgcttgcagcctgtatcttagcagggaaccctttggaaacccagtctccagagaaagtttgacgggcatcttggcataggctgctgcctggtattactcaaaaagaagggctgttcatttccagcaggtgttaagagctgagtaaggcccatagcatggaaatacgatcatctctgcccctacagagttacatataccttttggttgtttgaaattacttatttggtagctctgtttgatgtaacaagaaacagactcctaggccaaattgaaacgccttttgtattatctctacttaatttcttctacccccagttgattctctcttaccttaatcacattattatgaataattgaagagctgatgatgcatttttcagcctaaggttttctgatgaggactaaagcatctgatcaaatttcatgttcatgatttcaacttcacagccagtatctattcactcaaaagctttattaaatctcttctttcggccgggtgtggtggctcatgcctgtaatcccagcactttgggaggctgcggtggggggatcgcttgaagccaggagttcgagaccagcctggccaacgtggcgaagaaacctaatctctatggaagatacaaaaattagctgggcgtggtgtcatgcgtctgtagtctcagctactcaggaggctaaggcaggggaatcacttgaacccaggaggtggaggttgcagtgagctgagattgtgccactgcactccagcctgggcaacagagagagactctgtcttaaaataaataaatctcttcttttttcatcttgagtcccttcttctctccaaatatcaggccctcttttactgtctcccttaattttcacattttatttggtccagatagtcttgtatcttaaaaaacagtaattctcaaaatttgagtattctgcttctaaatgccagagtccctgaagagtcttaattcttcaataaatgtatggtagaataatgccattgctaaactgtataaaaacaggattttaaaactaaaaataaaaccacattaatcttgaatttgctaaaattatgtttttgattagcttgttttatgatacctggcctactgggcctcccaaattgctgggattacaggcgtgagccaccacacacgactgaaagaagagatttaataaagcttttgagtgaggccaggtgcagtggctcacgcctgtaactctagcacttcaggaggctgaagtgggaggatcatgaggtcaggagttcaagaccagcctgaccaacatggtgaaacctcctctctactgaaaatacaaaaactagccttgcatggtggcgcacacttgtaatcccagctactcaggaggctgaggcaggagaattgcttgaacccgggaggtggagggtgcagtgagccgagatcacgccactgcactttagcctgggcgacggagcgacactctgtctcaaaaaaaaaaaaaaaaaaaaaaaaaaaaaaaaaaaaaaaaaaaaaaaaaaaaaaaaaagaaaaatcgttaataatgtgtgtatttggtgttttctgtcaacaggaagaaggtagataatgactataatgcccttcgagaaagactcagcaccttgcctgataaattgtcttataatataatggtatgtttggtgtgtttcttttaaagtaatagttgtttcttgtaaacatattaactatgtgtcggttcacagaatgtcaggctgatggactgtgtccaaggtaactatgtagcaaggaagatttgttttgttttactttataagaacacagtaattgtagtaattgttggtatttacctttttttttcagaatatatatggtgacacaaatgacataaatattagcacaaaattggacatatttcaaatggaaacttactatataaaaaatgtaattatgacagaaatatggtactaagtcgtttcttgttagccagagcaggaataggccataatgttttgtaattcacagaattaaaccttaggacattgatttttatataaaaacgtgctgctaatttttgttttaatgatcttcacatcgacatagtgatctgttcatgagccctggattagagcctttcattgcatgaatgttctttcttatgaagactttgttcttttatactagtccaagtattttgtatatatagctagatagatccattaaagctatttgtttactaattcctgctttgcaaaagtgtctactttattgaaaataatttttagttttctttatcaaaagtattttgcattgacaatgtttcactactagttgctttcacttagatttgcaagtgaatgaaaagtataaacatgccgagacagtactactttctttaagagctatatgtaaatatggtgtggatttattttcctgttttaacattgatttatgaacataaagcaattttctttagattttcctagtaaaattttaatatagtgttgaatttctgtgaagctggcattttatttttcccaatgtataaataaaaaaattcagttatgtaaggcttttaatgcgaagtgttttataaaatgtacttttcagtgttttatgttttttcccttttttctttttttttaaacaataggtaccatttggcccttttgccttcatgccaggaaaacttgtccatactaatgaagtcactgttttactgggggacaactggtttgcaaagtgctcagcaaagcaggctgtaggtttagttgagcaccggaaagaacgtaggtacccattttaaatgatgtttctttgttgtatatgtatccattcacagattgccaagctgaagggctgtttcttaccaaaagtaccttccgtgatctatgaatccaggctgtttgtgattctgttgaattgtaggtagtttgagtagaaccaacatttgagaatgagctggagaatggagcatccgggttggaaatgtcacctacattggcatgttttcagaagttacaaagtttcaaagtcattatgtgattttgtagttagaagttgggaagacataaaaattggagtcattttataccttataatttttttttagttgctattatagacttatttttgcacttaatactttagtacacagaaataatgtgttttctccttagtgaactaagagaaatacctgtttacataagtagacaattcttaaaaatgctttttggtttggaaaaaaaaccatattttcatttgatagaggagaccaggtgtgaaaaggtgctacctaaaacagcacccttatcctttttcagttgtttgagttctctgcatccctttattagggcagctcttgagttttgtttatccgtgctattatctgtaggtgtatagaagcctacatacacacacacaacacacactacacattttgcagttggatgagctagcttgggttctagcttagttatattttaaaattaggttcagtttataatctgttgttatttctgtaatacgtatttagattgagagtataatatccgccctacctgctttttaaccttttagttaaatgtgtatttgaaaataaatgatgggaagatccttttttataaataaggtcatactaaacagaaaacagctgagttttctaaagctgaacttgatttcacttatacatgaatgagtactagagaactcatttactcagtgaaattctgggaactatatttggagactctaattgcaaatcaactcctataagtttataattgatatatattttgatcttttgtgacactaatcagaatcttattgttaggcctgtatgtaatttctggcaatgataaatcttttggctttgctgcattatttttgtcatgtatattagcgaaagagaatgggcatacttttttcttaaagaccttactgaagacgaagcctctctttatatactgaagtagctctgatgttatgaaatgaatccatagcctgttgaagtttgttcacattgattttcatatttcagtgaaaaaaatctttataattagttataacttaaaatattaatgggaatacttatactacaatagaatagagctctagagtagagaaacatgtttttgtaaatcactttctagtagttaaatatggttttggaaagtgaccaaacatagatgacttttgggatcaatatttatctaaaataattttcaaagtacatatttcctgttacaataaattctgggccgggcgcaggggctcatgcctgtaatcccagcactttgggaggacaaggcaggtggatcacctgaggtcaggagtccgagaccagcccgaccaacgtggtaaaacctcgtctctactaaaaatacaaaaattagccgggcgtggtggtgtgtgcctgtagtcccagctacttgggaggctgagacaggagaatcacttgaacccaggaggtggaggttgcagtgagctgagattgtgccactgcactccagcctgggcaacaaagcgaaattttgtctcaaaaaaaaaaaaaaaattacgtaaagctcttttattcacatggttttataatttatacctgaagaaaatacttaggtatattgttgtacttcacatttattaagaaaaggtactttatttttcttaaggcagaggaaatataaccagttaaacacatagtcatctatgtcatggttgattggggtaattggggaaggtctgagttacaacacgggtcatgatttgtttagccagcaccacagtcaggacacggaataggatacaagatactgctctcaggactcagctcctatcaaaacctccctcacactgccccttggtggtcacaccctacggctgcctactgctgaaggattgacgacttcacgtctgtgtcttttgagattagcttcttcacttgctgtaacgcctcatccaggtggttctgtgtattcaaagttcatttcttttattgctgaggagtgttccgttacatgcatatctattaaatgcacgtacagcagtttttccattcaccttttgagggacatttgggtgcttccattttttggcggttaggaacagagctgctgtaagcctttgtgtacaggtttttgtgcgaacatacatttttattgctgttggtaaatacctacaagtgagattgttagatcatatgataaatgtatgttcaatttttaagagactaccaagctgttttccaaagtggctgtatgatttacatctctttcagcagtgtgtgatagtggtatctttgcgtctctaccagccctcaatattgtcagtttaagaagtgtagccatttgaataggtgtatagtgattttagtttgcatcattgcctaatgatgttgagcattgattcatgcacttattttatctttgtgtcctcttttacctgttgaactcttttgcccattttaaaatattgggttatatatgcttttttttttttattttttgagatggagtctcactctgtcgcctaggctggagtgcagtggggcgatcttggctcactgcaaccttagcctccgaggttcgagcaattctcctgcctcagcctcctgagtagctgggattacagacatgcgccaccatgcccggctaatttttttgtacttttagtagagatggggtttcaccatgttggtcaggctggtcttgaactcctgacctcaggtgatccacccgcctcagcctctgaaagtgctgcgattacaggcgtgtgccattgcacctggcctgggttatatattttctttctttttttttgagatggagtctcactctgtcgcccaggctggagtgcagtggcgcgatgtcagttcatcgcaacctccgcctcccgggttcaagtgattctcctgctcagcctcctgagtagctgagattacaggtgcgtaccaccacgcccggctaatttttgtatttttagtagagacagggtttcaccatgttggtcaggctggtcttgaactcctgacctcatgatctgtccgccttgtggtccacccaccttggcctcccaaagtgctgagattacaggtatgagccaccgcaccccgctgcattgtatattttcttactgtcgttttgagagtttttttttttttaatatattctggatttatgttaaataggtgatgtgcaaatattttctcccactttgcatcttgtcttttcattctcttaacagtgtctttccagagcaagtttttaattatgaagttcagcttttagctttttttaatggatcatatgtgtggtgtcatatctaagaacgctttacctaaccttagttgttgaagattttcttctgtgttttcttctgaaagttttatactttgatattttacaattagatctgtgattgattttaagttaatttttgtttgaggtgtggggtttaggtcacggttcatttttcttgcatatggatgtccagttgctccaatactatgttgaaaatactgttctgtctccattgaaatgactttgcacctttgtcaaaatgaattggcaacaagaccatcttagataccacactaggatggttataataaaaaagacagtaacacttgttggtgaggatgtgaaaaaattggaaccctcattcattgctggtgggactgtaaactggggaagccactttggagaacagtttggaatttttcagcaagttaaacattgtgttttactgtgatctagcagttccacacctagatagtattctacccaagggaaataaaaatgtatgtccacaaatacttgtacatgaatattaagagcagcactgcttatagtagccgaaacatggaaacaacctaaatgtctatcaactaataacaggtgaataagtgtcgtacatccatgcagtggaatgttgtttggcaataaaaagatgtgtaccttgaaaacattagaataaattaaagaaaccagtcacaaaagaccatatattgtatgattccatttacatgaaatattcagaaaaggtaaatttataaaagaaaggagagtagtggctgcttagggccaggaaggtgtgagagagaatggagagtgactgctaaagagtatggagatttttaggggcaatgaaaatacaaaaatacagattttggtaatggttgcacaaccctttgaatatacgaaaaccatcaaattgtacattttaaatgggtgaattgtatgttatgtgaattataacttaaattgttaaaaaacaaatgaatgagccattttgtgtaattgtgtttttggaccatctgttctgtttctttatctatgtgtctgtctctttgctgatgccactctgttttgattactgtagcattatagtgttccttacagtgttccttaaagttggtagtacgggtgctctaagtttattctttccaaattgttttggctgttctacctcctttgcctttccatatacattttagaaaccactcgcttatgtttacaaaaactcctagtgggattttgattggaatcgcactaaatcaacacattaatttggggagaattgacctcttaactattaaatcttccagtgtgtaaatacttacagcctgtaaatacagtgtatctctgtatttaggacttctttaatcagttttgtagtttttgagcatacaggtcatatgcgttttgttaggtttatatctaagtgtttcaccttttgtggagctgttgtaaatgatggcattttaaaatcttgtttttcaagtgttctagtatatagaaataactctttttaaaaaagaattaacattgtatcctccattcatgctgaccacatttgttctctgaacttttttggggtagattccatgggattttctatgtagacaatcatgccttttgtaaatagctcctatttttttttattcctttccaaggtgtatacacttcatttctttttcttgccttacttccttggctaggacttgcagtataatattgaataggagtggtaagagtaggtaggtgtctttgtcttgaaactgatcttctggggaaaaatttggcattttattgttaagtgtgtgttagctgtaggttttttaaaaaaattaatactccctataagtttagggaactttctacctggttctaatttgcggattttttaaatgaaaatatgttgaattttgtccagtgtattttctgcatctattgatatgatcttgtagtttttcttctgtatctgttaatgtggtggattatattgattgatttttcttccctggatgaaccgcatttgatcatggtgtattctttcatgtattactggatttgatacattgagctttttttgtttaatatttgcatggcgtatatttttccatttcttttacttttatgctaactatatcatatttaaagtgggtttcttttttttgttcttttgagacagagtcttgctctattgcccaggctggagtgcagtggcctgatcttgactcactgcaacctccacctcccaagttcaagtggttctcccgcctcagcctcccgagtagtggggattacaggcgagtgccaccatgcccagctaatctttgtattttttatagagatggggtttcaccatgttggctaggctgatctcgaacccttgacctcaagtgatctgcctaccttggcctcccaaagtgctaggtttacaggcgtgagccactgtgcctggcctaaagtgagtttcttataggcagcatggatctttcctttttaattgattctgataatttcagtcttttaattgatgtacttagaccatttacatttaatgtaatatgtttggattcaggtttggcattcccccgtttttgttcctcttgttaccctttcttgtcctcttttagattatttaatatttttagtatcttattactctgttgttgctgaaataggaacttcttaaagtatttttaatgttacaaattagggattaatgtatttcacgtgaacttaaaagttttactctaaatacttgctttgagatttgctgaattcttttttacgttagagagcaatttttggcttagaaaggagtacatcttcaatgagactaagtgaaaagaccaggatttaatcagaggtttctacagtatagacaagtttttggtaattttgtttctgcatgtctctgtaatctacttttgaacaccggtatatagaatgacttgaaattctagtatctaggcaccatgtcttagaatttttggctgtgacaacaggcatttggccacatttctagtcattagtccagtgattaatgttaaacagttttacttataggatgatcttaatagattttcctttcaaagataatatggggagaattattttaccgtgtgtcttttgttcagaattgtatctgacacatttattttatcttatttttacttttgtcttaaaaatgcatacttagtcttcatttttacaataaagttatttttattaaatggaagagtggacatgaagggataagagcatgaactaggggtaatggctataggcttagagaagagatcagaagcaggaagaatttctgagcctgataggacttggcaactgattgaatgtgaaggttgaggggaagcattggatgagtggtgacctagaggcaatgttgttgacataatcaagtaagtttgtagatcactgcacactactttccctctaccagagagtaaaatgcacataggcacgttacttagaagccctgtaatgaaaaatatccctttagtcttgtttaatgttgtggttcccaaacttacttgattttgagaaacttttaaaatgtaatgtctgttatcttacagagcattctaaagaaaatcttgatttaggaatacatttttaggcagatttcagaagaaagtgggtgataagacgttagcaccgaatacagcttttttttttaagtgataggagaagaaagattgtatgaggtgcatcaggtcattcacaagatgggcttttttaaaaattatttttttagtaggttatatatggacatgatacaaaatctaaaggatatttattaaaaaacaactatgcttccttttcttgttctttaacatccagtttacctccctggaggcatcgctgttatcagtatcttactcattattccagggatattctgtgcatttacagccatagacttatgcattcctaccccaccctatacacctccactcaaattgtaggcacacttttatttttttgttttggcagcttgctgtcttattcttttcatggctatatagtattatattgtactctatttagccagtcctttactgataggcctttagatcgtcttcctttttttttgctgttaaaatcaatgctgcagtgaataacctctgtgtgtatgtgtgtgtgtgtgtgtgtgtatcatttgtacttgtgtgtatctgtagtataaatgacttaagatacaattgctggcatgaagtgaagtagatttttaactttgacagtgctggctttaacagactgactacacctttgccaacccaatgtgtttgcaaacttgttttgaaactgataccttattgtaggccccctggcactgctaactagctaacttactgtcttttcctccttttcctcccctcccctcccttcccttcccctcattcacatggttggtcagctataaccaccatccatctccagatatttttcatcttctcaaattaaaactgtaccagttaggtgataactccccattttttccttcctccccccatcccctggtaaccactattctactttccatatgaatttggctattctagataccttacataagtggaatcctacagcatttgtccttttgtgtctggattatttcacatagcataatgttttctaggttcatctgtgttgtagcacgtgtcagaatttccttttttttaaggatgaacaatattttattttgtgaataatgtgaattattctgttcgctattgtgaatagtgctgctatgaatataggtatacaaatatttatttagttccctgctttaaattatttggggtgtatatctgaaagtggaattgctggatcatatggaaattctgtggatttttttttttttttttgaggcagggtctcactctgttgcccaggctgggagtgcagtggtgcaatcttggctcactgcagcctccgcctcccaggttcaagagccttcctgcctcagcctcctgagtagctgggactacaggtgtgcaccaccatgcccgactaattttttgtatttttagtagagacagggtttcaccatgttggccaggctgatcttgaactcctgacctcaggtgatgcatctgcctcagtctcccaaagtgctgggattacaggtgtgagccaccacgcccggccctatgttgtattttttaaggaacctccattctgtctttcacagcagctgtaccattttatattctcaacaccaaaatacaaggaatccagttttcccacattcttgtcaacacttgttactatattttttatatataaaataaatatattttgaagtggcatatcatcaaggaatatagtttgaagtggatttgaagtgaagtatcagcagggttttgatttgtatttcttcagtgattaattatgttgagcatcttttcatgtgtttattggccacatgtatatcatctttggagaaatgtctattcaagtcttttgcccattttttatttgggttgtttgtttttcttgttcagttgtagttctttatatattctggatattagtcccttatcagaagtgtaatttgcaaatattttctcctggtctgttggttgcccttttactttcttcttttattttgtcttacttaaaaaaaaaaatagctgccaggtagagtgcccttttactttcttgataatgttgtttgatgcacaaaaatttttaattttcactgtccagttagtgtttttttgtttttgcctatgcttttcatgtcatatctaagaaattgttgccaaatgtcatgaagcagcttccctgtgtttttttttttgagtttcctagatttagctttcatttaggttgctgtatccattttatatatgcttgtaaggtaagggtccaactttattcttttgcatgtggttccagttttctcaacacgatttgctgaaaacactgtccttacctttttgaatggtttttacactcttgtcaaaaatcatttggtcatacatttatgaggtcttatgtctgagctttgtattctattttttggtccgtaagtctgtatttatgttggtaccacattattttgatgagggtagctttatagtaagttttgaaaacagaaagatgagacttacaacttagtttttctttttaaatattgttttggttattggggaacccttgagactccatgtgaattttagaatgggcttttctgtttttgcaaaaaaaaaattactggattttactgggagttgcactgagtctgttggttgccatgggtagtattgacatcctaattattaaatatattcactccgtgaacataggatatctatttatttgtgtcttatttgttttagcaacactttatagtttttagtgtgcaagtcttgcaccttcttaagagtttagtccttttggttctagtttaaatgaattgcttacaaatttcctttttagattgctcattgttagtgcatagaaatgcagttgatttttgtgtgttgattttgcatcctgcaactttgctgaattttttttattagctttacaagggtgttttgtgtgtgtgtgtgtgtgtgtattctttagggttttctgcatattacatataagattgtatcatatgttggtagtagagagaacttgacttctttccaatttggaggctttttatttgtttttcttgcttaattgctctagctagaacttctagtatgttgttgaatagacatgttcatagtgagcatccttgtcttattcccaatcttaggggagagactcgcagtctttcatcatagagtgtgatgtcagtgtggggttttcatatatggcctttattatgttatggaagttcccttctgtttctaatttattgagtttttttttttaatcatgaaaggttgttggattttgtcaaaggcttttttggattcaatcgagattaccatgttttttcctcttcattctgctaatgtagtatattacattgatttttatatgttgaacccatccttgcattccagggtgtggcagagatcattcttggtcatgatgtatcattcttttaatgtgctaccgtatttagtttgccagcattttgttgaggatttttatatgtatattcataagagaaattagcctgtagttttcatatttttatctggctggctcacagaatgtgttccctcccttttcattgtttagaagagtttgagaggattggtgttaattctttgaatgtttggtagaattcatctgtgaaagcatctcttcttggtcctttctttgttgggaggtttttgattactgattcaatatgctacttgttacaagtctattcagatttcagttttggtagtttgtgtttttctaggaatttgtctattttatctaaattatcaaacttgttggcagtcagttgtttgtactatttctgtataatcccattaatttctgtaatagtttttattgttccacttttgtttgtgattttagtgatttgaatcttctctttttttcttagacagtctaataaagatttgtcaattttgttgatcttgtaaaaaaccaacttttggttgcattaatttttcagcattttataaaaattctgttttgtttatcattctctaatctttgttattcctttcttctgttagctttgggttcagtttactctttcttttttttccagtttcttaaagtgtacagtgaagttactgatttgaagtatttctttttttttgatgtaggtatttacagctataaatatctttcttagcattgctttgctgcatcccataaattttcgttgagttttcatttttgttggtctcagggtattttctcttttcttttgagacagagtctcactcactctgttgccctggctggagtgcagtggtgcaatatcggctcactgtaacttccatctcccgcgttgaagggattcttctgcctcagcctccctagtagttgggactacaggtgagggctaccatgcctggctaatttttgtatttttagtagagtcggggtttcaccatgttgtccaggctagtcttgaattcctggcctcaagcaatctgcctgcctcggcctcctaaagtgctgggagccactgtgcccagccatattttttaattatgcctatgatttcttctttgacccattgacagattattttgtaaaattttcatatatttatgactttttccaattttccttctattaatgatttttaatgttattgagcattccagttagaaaagatactttatatgatttcaatcttgttaaatttttcgagacttattttgtggcctctcatatgacctatcctggtgactgttccatgtttcccttagaaggtgtgtatttttcctgttgttgggtggaggtttctatatatgtctattaggtctaattggtctttagtggtgttcatgttctttatttccttctggctgttctgtcctttattgaaaaggggatattcatgtctcctccagctattatggtgaaataatttctcccttctgttctgtacatttttgctttgtacatttgagctctgttaggtatgtatgtatttataattgttgtatcttgatagattgaaccttttatcagtgtgaaatatcctttgtctcttgtgacttttttaatttaaagtctattttgtctgatactactatagctacttcatttcttttttggttactattggtatggaatatctttttcattccttcactttcaacctatttgtgcccttagatctacaagtgagtctcttatagacagtatatagttggatcctttttttaaaacaattgattctgccaatttatgctttttgattgggaagtttaatctgtttacatgtatagtaattactgatgggggaaagactttcgctgttttgttattttctgcatgttttatagcttttttttgactcatttctatattactgccttcctttgtgtttgatttttttttatggtgaatggttttgatctccttttcacttctttttaaaatataggtattttctttgtggttaccatggcgattacatagaacatcctaaggttataaaatgtattttgaatttataccaacttaacttcaatcacatacagaggctttattcctgttcagctccttcacctctttatattatttgtgtcacaaattatatctttatatattgtgtctccattaatatagatgtccagtgatgtgtattcatttttctttatcacatagaaaagaaaaaagtggagttacaaaccaaaatgacagtaatacttatttttgcctatgtgtttacctttatcagagatctgtgttttcatatagctttgagttactgtcttttcatttctacccgaagaacttcctttagcatttcttggattgcaggtctagtggtgaggaatgccctcaactcttgtttatctgggaatatcttaaatttcccctcatttttaaaagactgttgttttgctaaacatagaattcttggatgaagtattttgtttctctctcagcactttttaaatatatgtcatcccataaccttctgtgcttcagggtttctgctgagaaatctgataatcttgttgaagatttcttgtttgtgatgagtggtttttctcttgatgctttcaagattctctctttgttgttgttcaacagtttgattatagtgtgtcttggtgtgggtctgggtttatcctacttggatttcgttgagcttcttggatttgtagattcgtaccttatcaagcaatgtgtatgctcttgagtatctccaataaggcatttcaaaatacaaatttatgattttagtttatgatagatgtatatagctttaaataaccacaaaccatcttaagacgttatttaaaaaaaagagcagcattcacttatcccttttggctcacagttcccattcctcagatgtaattactttctgtttttggctatttttactctgctctttttattcatattttccagtggttggcatatcctgtttttgtttacttcttttttttttaattttatgtattattaactacctgtctataatttaagaggaccatgtagcatttttacatgtcctccctgtctctgcttctctaatctttttgctattgttgtatcacaatttttgttgaatcagtattcatgcttagatattatgtaattccattttgttcttgtacaggcttttagttgaatttaactgctttttttgttgcatagttttctatgtgtctgtcattaattcagtcagatactttttttgttgttaaaaattttactgctggagtctttcattgtcttgcttcaatttggactggcttctctcctgatcaaaggagagccgtcttcctggtgtcttcttaccctgtttttgccttttatttatttcctgttttctgtttcccaaagcacccttttttcaggttctatttagtttgttggaatattgctttaagtaacttttgggaacctgctcggaggtacttctttgaatttttatgtatctgaataactcttatattccttatactcctgcttcttattgttaagtagactgtttagaattctaggtcttaagtaactgttgccctcagaattttggatacattattctgttacctcctgtctttaagtgttgctattgaaaatcttgatgctattttcgttttctttgtatataacttgtttttttgtttttaaagctttgagattcctttttggtccttattccccatgatctggaatacaacagtggtacaccttgaagccgtgctatggatcctttaaaatttgtttgctagtgcttagtaggccttttttgagtggaggcttaagtcctccagccgtgggaaatttatattagtaatttgaaaatttccttttcttgttgcctatttgtttgtccttgttgtaatttttgaagtgatttcttctgcatactcttttaaatcatgtattgactttaaaattttcctgtacatagtttcatttctggaagcactttttttttgttctttggctgtttctttgttacagcatcctgttcttgtttcatggatggagggtctttttttaaggagtatttgttttttcttttaaagttttcatctttaaacatttcctccatgtttcttttttcttctccctcttttctctcttgctctctttttttggtctctagcattaatgttcaagaatttcttcaaatgtctggtgatccttggctaaccatttatacttgcgttgagtactgtcaggaagctctgtgtgcataggcaaggtttgttgactgataggtattttttgtagggatttaaggtagcaagctgatttatttattttttttaaattgagcaatctttaagtatcagcagattctacaaaagagtcttctgatcttcttcatctagtgttctgagaaccaggctgggcgtttcaaggttcagtatgttcacttggaattaatcctcctggtttcactaagacattttctattctctttccacttccctattccctaccatctctacaaaccactctaagctgtgaatcttttgtttaagcaagaaaggagaaacctttcttgtgagattagggtttggggacctgttcttttcaaacttttatctagatctttggttaaagttcactcttcttttggaaatactctcaagtgaattgccttttccaggtccgatatcccagatcgacttgtagtagcttttcccagccacagttaggttccatttttttctgttgtgcaaagtccattatcagttgtgcagtttccaaaatttggttgacatttcttgtctattttctcttcaaatgtatttgtctttatgggtttatgcctttaaaaatttcttagttgttactttacctaaggtataggggaaaggcaaatactaagtacatgtattcaatgtgctattttaaagcagaagtccaaacctttgtactggtttaagaaggagtacatcctgtccagaggtttgtgagtatttccaccagggggcacgtcctgttgaagctgtcgaaagaatatttaaaaattccagcacacaaaagaaacgaggttgagaatagagtggtcacaaaggattcagtagagaattgcatatttacaggcttcatactattcagtacatatgaatatatggctaagtaaaaaagactcctttcacgaatgatgttcataacttttattagtgttttgcaaataatttttattacatctgcatttctgttcctttcaaatatatacaattctacaaactgttaactaaatgtttctaaatatttggtcttacttagtgagtaggcatatcgtttatctttaggtgaaaatgactgcttaagttcttatgaggttttaaattttcttttttggtttaaacatgtctttggaatttgcactgttaatttgctttaagtctcctttttcatagctaactcaaaggatttcagccagttctggacaaagattctgaattagtgaagactttaaaatattagcttatgcttgctgcacatttaacctgcagcctggttttgtcagctaaataaataaaaactatacctcattctatacttctgaaatcctagaaaatttaacttctgatttttagttaaaataacctgtgtttgaaaacaatcttctgtccttcaaattactaatttttttcttcaattttagtttttattttttggggtggggggaagtatctgtggagaactgtcttttgtacattttcacagctatttctttgatcccattgaatttgttttcttttttctataataattggtaactaaaatgtttgagattaaaatgaatacagatattgtctatatcacaaagtatatttctttttctctcagtagtgttatttgctataatttcagtgtggtttgaaattttgcttaattagatttcaacttagccatgtttggagcgttaaaattgattgagtctgtttaaatgatccatttttagtgacatgtatatttcacctcttaaaataaatttttggagaatagagtacaaaagctttagtgaaaaatgtaatagcatggtttctaatgttaaatctcagagttatagaaagaaatggaattaaattctcattctgcttttttaactgttgttcttttgaaacaacctgtagatacgaatttagacttgttatttactttgtacaaaatcgaaataggtgcttaccattctgctgtattttatgttattgtgagcaccaggttcgtttgccttgcggttgcccagctttcttttgtcttgtcttaaattttctgtatagctatctaattttttgttgctctaggacataggacttatgataatttaatagagatatatatctgcatatataatgtgtatgtgacggtgttggtgcttatcagtttgtggtatttctgagattctgatataaagtatatgcttttgagatctgatttcttaaccttgtgatagtggtttatattaatgtatgattcagaaagctttcttgaatttaaaaatggaactgtgcaatcgtatttcagtttttcataattaccctatttccaaaacactttgtttcttaaatggaatattcacacaactttttcttacatgcgtgagttatgatgaattttttttaaagtcaacaatagttgattgaaagtaactcctataacatcagtgaacaatcaattctttacacattgacaacccaaggctttcactgatacctttagcttagttgcacagtatttatatgtggatagacttttaaaaatgtacttagcttacctacctgccatttttaatattttccagtcttcttgaaaaaagttattgatttgacctcctacctaaaataatgttctttagatctaaagctggttagacacattatctgactgagtttactgaagcaaaaacattccataaccttaaccttttccctgaccccctgcttttaacaactgccgacatagttttatgctgttatgtgaccatgctcggatgaaatctgtcaaacagctccttgagttattaggctgtctgagtctgacctttctgcaatcaaagatatatgacttaagggctcagatttgccatggcaaccggtccaatttgctgccgtgagaaaaggtctaattgttgcagaaatttaatgatctagagcgacatcagggctgtgagattttatgaactgtttacaccgtaattttcattttgttaatgcagtcttttttttgtaacccattcatggctagagcataagtgattgtgttttatttaaaatagcattgcatagcatgagagccgtatcggagaacatgtgccactctcgagaagcccttcatatgtggtgatatttcacttttaactcccttccttattttcattcttttaaaagatattttaactgcttagacctttgccagacctgcattcatcattggtagagaaagaactatgtacttttctcctccatcctcttctgatctgcttactgattgagtgcctgttgtaaaacagtaggaaatcacagagcatctgggggaggaggtatcatatcactgtctattattctttatcagcgcttggccataaaaattctgtatttggagaaaagtaggatattgttcagcatataattatagttagaaaccccatgtattttttagatggtgccatttactgcttagcagagatttctactctgattacagaaacatgaattacttgttgcatttgtccagtattgggtagagaaatgtttgtgtctattctcaaattaaaatttttcctcaaataggttaatagagggtggtatttaggagatgttgaaaggctgtgtgttgtgttgttatgcagtttaacttggaaatggttgattatataccgtaaaaaatgtgttgtattttcagtcatctaatttaggaatattttctgttcaggaacagaataacttgtcttaatctatgttatctatgcattatccagctggacaaaaattacctgtgcaacaaaactgttatgaaatactgcattttatgtgatgatccaactagatatttatcctatagaaacctggtagcaccaggcagcatctacaatctagttctgtactctgtaatagagagaaaatatgttagacattttattacgaacaaagtaatgtgctatatatatagcacaaaaatacacagtataacttattaaaagtccatttaaaaggaaaatagtgtaagatttttgaaaagcattactgttaaatcatacttgtagtgtgataggactacagttaaaatattcctacaggtcgtatatatgccatgctttacataatggttgtgttcattgtttcagatgtaagaaaaacaatagatgacttaaaaaaagtgatgaaaaattttgaatccagagttgaattcacagaagatttgcagaaaatgagcgatgtgagtatttgtttttagtcttctatatttttagaaaatattttcaaagaaatatgaagctatcttacagccaaggaacaaattaattgaagtttaaaatgctttcagacatcttaggttgaatagttgctctttggataattttagtatgctggagatttgtgttgttaatacgctttttttttgtttaaaaaccaggctgcaggtgatattgttgacatacgagaagaaattaaatgtgacttcgaatttaaaggtaagcagtaagattgttttatgtgtagctgtttagatattttgatttttgttgattttcagtgggctttctgtgagatatttgggatttagaatacacttttaaattcataggatgccaacatttttctactcattgatttttttttatgtgaaacattaatggataaataacttttggttaaaaatgtgattcctgactggtctgttttagtggtgggattacatggcttttttctcccaaagttctccagtgctccaaacctctaaaactcagaagatgtatattctagacatggatctgctcctaatttgttctctgaccatggtgaagtcctaagatatcttttgctagtttttcttcttttaaaactgcagctttgtaagctgtttttggaagaatgaatgaatgtgggtgtatttcagccattcctcttatggtgcctgcagtggctttccctgcgcaggttgttcccatctccacccagtagatttcttttgccaaggctggcttatgtgtttgggtttacttctgtaaagccaatggttccttcgtcagttgtaaagtgttaacggtagtgaaattgtaaaaagtattacagatggcttattatttgctactgtagaagactgtacagtgtcttaaacaaatgtactgagcattcgttttgactttcagcactcatattttggtgatgaactcttaagataacttactggttgaaagaagccacatcacaagtaacaggaagtggctttagaaggtgaaataaaggatatgtatattaaagttgaacagaaagacaagatttttgtttgtggtgaccagtgacaaattatgagcgctacaggtctgaaataaaaattgttaactactgtcttatcaataatagttacagagaataaggctgtgaaacataatttgatattttcagatgtatgcaacaatgcagcaaatttgaatatatgatggactcgaggtcatctggtagtgccatatctcataacaggacgcatcttagacttcttcccattactttcccattactttgctttaataaagcaaataaagccttaatttgctttattaaaaaataatctattttttaaaatgaaaagcagatacctctgagttcagatttgacccatcttttttcctcacatgaagattacaaatgaagcagtttaaaaagtagagatgttcatatgtaaaatgataatagaactttacagagatgagccgccgttgtttccttgtagggtactcattccttggcagtgccctggagtttaaagtatcctgtcacaaggcttttgcacgttactgtagtaactagatttccttgagtaaggatggtaaatggaaatttatcatttatgtgttgcatttcgccttataaccagggtgcattgtggccatttcttatgcatttttgaagctcttctcacaaccttgaatgtgtatgcaggttctctggggctcttgttgaaatacagattctgattcagtgggtctagggtgtccttagagcttacacttctgaagtgttccccaaggacgccagtgctgttgatccatggaccacactttgagtagcaaggctgtaagagacattcatccttggagttctgtttggcttaaaaattgtgacccctctgtttcaatatttcccttgccccaaaagaaagtctcattaagtctgggtttgtgccttttttatgttggctattaacagccacgtcttttcctttttctaaatagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgataggtacttgatgacaaattatctttccaagataatttgtttctatacacatttcctcattaatctttttcttcattaataaaataatatgtgttcattgaagaaaatgcagggaagcataatatattatcaataatcctttcacctcaagatgaacattaattctctggaatattttcttataggattgtgtgtttgtgcatattcccatgcatgtacatgtacttaaatacttaagatcaacatcttcattttttattatggcctattttatataattaattataccagatagttgacttttaataatcatggatttaatatatataatgttaaattttaaatgaagtatttttatgccacacccaggatagtgctctatctttgaatgtgttgtgaaaaacaaaaatacactttgaatttaaatttgatacagtaaaatgtttattcttgctttccttttataaactttggagcaggtaatttgtaatctggtcagatagctatatgtatgagaaactttacgaaattgctgtttgaaatacacattagcacacacttagaattgttaaaatgctaaatgaaatctgctactcgagaagttctatattattttgcttaaatgatgtaccatatgcaataattagtttctgtgaaaaatagggcaggaagcataaaagtttctttttcctagtgtttcacctataaattcttaggtctttttgattaactaatactattcattttttaaaaccagttttggatcttgtgatttttcttggtcatgattctctttctattttttgtatgatgttatttcagttctgttgcattttcaattttgttatttttgtaaggtcctcacatcttttatagaatcaagtatgataaatgttcactcatgcatatagatatattcgtgtgcatatgtataaatcctttatttttaaaaattacaataatacatgctcattgtaaaatattctgagtataggagtagaaaataagtgtgtattatgtggtttcaatttctggtctttagagataaatgttctctgaatttcttacaactttattattattgatactatatttatattgcatatggccaatatctttcttgcaaagataaaaaaattatcttctatattctacttatgtctgaataacctcaatatatagaagcagcataggaactgttttttgttaatttatttcaaaacatttttttgtttttgaacttagaattctagttttaaaaatactttattcaagatcttagtatttacccatggaaactaactggaaatttaaataatgtaaaattctagtatgtttgtttgatcttgttaattttcttccttgctagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtttgtatacttttaactttactaattttgcatataatttgaacattaagcattatgatattttttagaagagcaatattaacaatcattatcattgtggatagtgccagacaggaaaatcatcttttgcctcttgttctgaccaatttaagaagaaaaagggaaaaaaaatttagttagctggtattggtccattgttctctgaaacaatgcattgtttggggtctggaaggggatcagatttgagtggcaactactgtaacttcacctgtccttcattcagagagttttcttaagaatcctggagttaattatattgtggacattttggtgtgcttaggatgttgaaagtgactgcattagttaaatttttaattatgccaggttgttttctatggacataaaatgaatacttcataggcacaaagggaaaatgtaggaggaagtaaaaattagtttcttttctgacaaagtaaatataaacatctgtggataatcatgacttagaattttggcattttagagctgggggtgactggagattttctaatacagagttttaaagcttttctctagtatgaaaagccttttgttccctccatacttactgtagaatcccagtatttaaaatagatcaaagcagcttggctctgattgaaggaaggataggctgccttaagtccatctttgccctctctctgctccatgtactgctctaaggggacactgggaattcgtctaattcgtctttctcagggaaatttaaggcctagaagacatagatctggttggtaacaaaacaggaactctttcgcctctgagtgccctttctacacaatatcccgattgcctgtatcagttaagggtctgtggtatcattcttaagtgtgtgtgattattatttagtgaaatatgtttaaaacatatttgatatttcttagcttcctaaagttattcctgctcctatatgaagtgaaataattgtttgtgtttttatattctaatatgtcagactgaaggggtcttcccctgattcttcgggaaaagttgactgagatgattagccagaaaaaaaggtcgctttttaatcttttgccaggcttttacttttttcctgttttcatttagataaaacagaaagaacaaatattatttgcaggaacgttacaggtaatagtggtcattattgtggaaagtatgctctaagtgctgactagggatagaaaaataacatgttaaccccatgtgaaccctgaacaggcttggtttttatttttttactccttcaatttctaaaaattagagatgttttaaaaattctaaataggcattatttaatagtacttttatgacttaaaggttgtattcttactgaatttttgtttatactctttcttttgaaatacataattcaagccaaacacttatatcaaaggaatggggtgatgggaagtttataagaaatctagcatttagttcaaatgtattttgctttctctacaataataaagacactgaagactaggatttgttaataaagaagattttctttagatgtcatagatctatgagataaggactttttaaaaaattccatctgataatgcacatcatttcagcatcagaaaatttcagctgcctctcttactattatttttttagttatagagtttatttgttttggtttcactttgatttaatttgtcaaaagattcttaatttcttgctctgaaattttaggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacaggtgggaggcgctcacagctgcagggcagtctgctgggcttgcctctctttctgccactgaacctttactggagaaagttgactgtaacacagaagaccctcactgaaaagtgaagtgttctgaggagttaacttaggatctgataggctgaccggctgtagcttcccagtccagagcagtgggaatggaggattttttttttttttcactttctcctcttcaccagtgcttttgaaacatttccaaatggtctagtcagaaaatcttgtatcttcagaaagcatttttgtttccagtgggctaggtccctacgtttctaccacagccgtaacatgcttggcatgcagtttaccttttcagagtagaaattatactgttgcaggttttttttttttttccttttttttggaattgtttgttgagaaaactatcacttgaaaatacctactgtttttatgacccttatttataaatcagtgaaaattgctaaatgtatacgtgggtctaaaactttatgtagaattttggcaaaccatgctattgccacctaggacatgcttaaaaataacatgctgtgtttttgttctcactcataggtgggaattgaacaatgagaacacttggacacagggtggggaacaccacacaccggggtctgtcatggggtggggggaggggggaaggatagcattaggagatacacctaatgtaaatgatgagttaatgggtgcagcacaccaacatggcacatgtatacatatgtaacaaacctgcacgttgtgcacatgtaccctagaacttaaagtataataaaataaataaataacatgctgtgttttattattaggccagagaaatagctttcaaaatagtatgaagataccatttgaggctataaaattattgtgattgtgactattttagatataagattgtaataaaaattttcagattaatttctagaatagattcaaggaaattttcaaaaagttgttctcagttttatgagttacgtatagtgaatgcatatgtgttttgaatatcacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggtgtgtgtgtgtatcttttaattctttatttcatatagtatctttgaccagttttagctatttaatctgaaaagtcataagattaaattaattctaggttttatactttcttggtactaattaataaaaaattaatagtcacaaacagtacaaatattgtgataatcaaatagtttattttttgataaacacattacttgtcttaacgttctatttcagcaaaatgggaaatttaaaatgtcttacttggcattatgtattacatttgtagctaggaaattatttcgcagtttattttaaataaattaccagtaggtcattttctgatagtgtaaggagcagattacattattctcttttaaataccttggctaagttaaagaaaaataatgcatgcatagcagataattacctaaagtctaatattttaccttgtaccagtgaaacttaactcttgggggattatggaattgttttataatctgatgaaagctgtagaccctgtccatagaaaaaatagtgcacactcaatacactttcacccaccacacttcttacagtttttggtggtggtgcaggggaggttaggaaatccccaaataaggatgtctgtgaaatataaggctattgatttcttcattcttgtgttttggtgcgtatttgaagttttcaatttaaaaagtatttaggaagattggggaacccatgcctggatcaaaccagtgtacacatttgtatatacaataagatacatgcatatatataaccttatctaaaaattccattgcttttactaaatggtattatactcagtgtattaaatggtaattggggatggagattggtagcatttagggacagtacatatgactagaatgttttcttcccctcttcttagtataatgatcttaggtgacctggaaagtatcttaccttatttgatagtcttccatactgttagaaaacaggtaatggatgttatcaggtaattgctgataaatgtttgaaaattagttttttgtaaggacttagtgtatcatggtacagctagagtgtggaacctattttttatttcacccttagtagctttgcattttgtatggaaatgtttaatagtagttgctatacattttttaacatcaaagaaatagttcatgattatggtaagtactttggaagatatccttttcagtatctttttaaatgctaaaatacctctttttcaaaggcattttaaatagaagaaggagaagaaggctctatgctcatcgtgataaagtggagtttttaggaaagtaagctttaagctgcttttaccagttgaactccaaaaataatgtaggagagagatggctttctttgtttttgtttcagtggtggggcaaggtagaagaaggtggctttttaaattatttaggtgttacgttgttttaactaattttgagcacttggtagacagaggagaacaaaatgtacattaaagttcacctgtcaaattttcatttgtagagggaaggatggaggttctaaataccagcaatcttaaaaaaaaaaaaaaaattaactccttgtgtcttacctatttttgtataaaacgacatgtacagatatttccagcaatttatgcacattctttaattctgttccagttgaacatatagttgaccagattaaatgcagcaaacatccaggtgaaattgagtcatttctttttttgtggaacttctgatttctgtcattgagttaattatattaaaattttgaaacctgtacttattcctactagtatcagcacttttatttttcaacttccactgatcttttaaaattgaggcaatatgcagtaaaatatttaaataattgcataaacaccaccaaagagatatcagttagaaatgtcagtactggtgaaactaagctattggctagcaggcagcaaggccatcataggatagctcattcatcaactgatgtacaaaagtcagagtttgacaccctaatagcatttttattttaatacattatttttcacagcatgggctggacatgaatggaatgtatgaaagtttgaagaccttttatttatccatttcttttttttcccagataaaatttacattttacattttgttttcttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctc

SEQ ID NO: 37527 - DNA, 36835 bp, Homo sapiens; identical to SEQ ID NO: 35756

SEQ ID NO: 37528 - DNA, 43457 bp, Homo sapiens; identical to SEQ ID NO: 36927

SEQ ID NO: 37529 - DNA, 27723 bp, Homo sapiens
gtagtcccggagtccgcgtgcgcggggccgggtccgggagccccagggcagccgccccgccgagtcgcaggtaccggtggggaacggggccacggggccgcgtgtcgggggctgcggggtgtctcggggccctggggtgagtgcggggcgcgggccgaggtttgcagggccctgtgaggtgagtgtgggggctggcgctggggtccgcggggccctggggagggtgcggggcgtgggccggggtctgcggtctgcagcctggggtccgcggggccctggggagggtgcggggcgtgggccggggtctgcggtctgcagcctggggtctggggggccctggggagggtgcggggcgtggccggggtctgcggtctgcagcctggggtctggggggccctggggagggtgcggggcgtgggccggggtctccgcgggggtcgcggtggcccgggcgcctggcagaaccgttgctgtgcagcgggtttcccgccgctcgctttccgccgcagcctgcgaatggggtggggagtcccggcccccagcctgccctccgcgtcatcctggggcgccaagtcccacccccgggtctggaggaaagcgtggatccggcgttcgcgcccaggcacgtgttgcttcgggacgggccagccggtgggtgaaccctgccagccacgcgtggggcgggcccctggcacatctccagaccattgtctcctgtgccagaagctttgtaggtgcaacttccccttggagcagctgtgggtgcggatccagcggagcaatcccgaggcgtctcagagagagcctggacagccgctggagcctttcccgagtgggtccttccaacaccgctacagcaggaaagccatccccctagggtcctgtccatcggaaactcctgtcctggggagtctggcctgcctggcctcaggacacaggccaactaagctggccccgaaatccagaatgcatccagagggaaggtgggataaagtccttggaggcgcctgttggccgccctgtaaagaggtggcctccccctacggagacccgaggatccccgcacagcccagattcaatcagcagagccgaggtgcctctggcccagtgcacctgcctgccctgtccaggcctgggagccaggctgcatctcactggccgcctttgcctgggtgccacctgtgcactgcttgttgcaattgctaattgctttctttccgaaggggctttggtggatttttataattccagatagtacagttatctctgctggacacagatgagaaagagtgcttctcgggtgtttgggcctgcagcagtgatagccggagggtctaattatgctgttaggaaccctgaacttggtcatctgaacaggggtgggagggtgtgcaatgctttcttcttcttctttttaaactagcaggcgttctaaaaaacataacgaacattcttggttagccttccagagtaggagctggtttaaacacggaatgataggtggcgtttgcttgtgttttgattgcgggtctctggccttctctggtgcttggaaggacagggcctgggtggggctggtcactgtggacagtggggccggggatttgcaggggctgttacaaccttctcctgaaggcagggattctctctgcttccccgtggccctcctgtctggtcggggacttccttcagatgccgggaagaggcctcaagctgtatgggactgggctggggtctggacacttggagtctaggcgtcccctggcttggggctgcgtttctatgatggtgaccaagttccctatctttcctcttggaggtggtctgggccgtgatggccaagcctctgtcagtgggctacgttcacggcacataagttgagtatgctggcagcagaggctgactgttaagaccagcagcagccccttgctggcggagactctggctgtctctccaaggaaggaatgttctggtcgcttctggaggtggcacctttcagaacagggggcccaagtacccagggctcccgggcccctgggggtcctgtgggtggggatctgactcctgcggccatggactgtgggcgcagaccctgggcttagttcagctcctgatggctccccgttgtctgcggcgatctggttgctctggttgtctggggatcggtgcgcctgtctaaacctgctgacaggtgggaaagtgaacttgacagggagtcccagggccaaatgggtctcccagtggggaggagtgggtgcggtctgaggtatgtccagctctacccgtggcctctctgggcatcagggtccctggtgatggagcccaacctttgtgcactgatcttcccagctgttgacaggccctgaggaggcatggaaggtgaggccgaggcaggcgaccgtcagatctgcctcggcctggcagtggcccctgcctgcgcttcctcctgcctggccggctgttttcatcctggccctttgagaacttctagggtcctggctgcctccaatggagggtgctggtcccatcttcttcccagctgtgccctgccgtggagctccggaaacctcgaggttcccctaacccttccccctcttccctgcggcccccattgcaagcccaccagcctctgcctcttaagggcttccctgccatcacctatgttcctttgtcacagacatgagtgtgtagaggtgtcaagacgggaccccagatgatgctgatggctttgcctaagtggcctggggagggtctctctctctggtccctgaaggccacctttttcctaagcctgtgtgtcaggttgggggcggttcagggagcacttccagcctgagtggtctctgatacgtgaagactgaatgctgagagcctggggcagattttcctaggggtccctggacccccaaagctggccccacatcgagggatgctctgagcccctgctggagggttggaggagacttctcaaatccagaccctctgcagaccccctgccaccctcccaagccggccctgtggcgaggcacaattgtccaactgtcagcccagtgcagatgggacggcgaccccgccccacaaggctgctcagctgccctctgcatgcgctgcatccccaccccacctgagcagcagatggcctttccacgtgcactctgccaggcctggcctccgggagcagaggtcagctgatacagacgtgaggtgcacctgtgggggaccagggccaggtcctggcctcacggggttggcttggtgtgggcgtctgacacacttgtttatggcagttcacttttgacttacttgaaggagaactttacaccgaggccttaatggaaaaccagggccacgtggcacctggagacatgattctgataagtggacaggcttttgccccgcagctgaaaggcacgatttgtggtggtgagacgtgcccttgcccgcaccggaggagcctttctcctgggcagaatcaggactgaaagagacacgccctcgagtgtgcttcgtgctgctgctgctccaccacgtgccctggccgtgtggggcgggggtgctggcgggatggtccccaaggttgggtgcatgttgcctcgtggatgaagtcctgtggtctggggtgctccatctggaacgtgtcaggtccactcatggctcctgccagctgctttcgtctagggtaacctgccgccggggatgctggggtccctgggctcaggggctgggcctcggctccatcccatcctccctcccacgcgtgtttcaaccctggctgctctcagccccctcaaggacacctgcttttccctctgcccttccctcactgtgggcttggcctgcacgccctcctgccagggcacgcggctgatggggacctgaggctggtacctgcagccacccgccgctggccacctgtggtgtgaccccggcctccagcagcgtccgttcctgcctgtgccctccctgggccacctgggtgccgctagagcagcagcaggcacgtgggctgccctcaggcctgtggggtgaggtgtgccccctgaccgccacaggtactgcccagcagtgccatgagtctagtgtggccccaaaccctaaattttgttagtttagttaataaagtaagtcaattagttaattaacttggttttgattggcacttaaatcactccatgtggctggagacttccctcagcctcggagaccctggaggtggtgacagcctggcctgggggactccggagcagctcaggtgtgggtggctcccagtttggtgctacggggtgaggatgggtctggggtctgcattcgtctccagggtggcgtttggtcctgagtggcgaggaggccggcactgggcctcgttttgcggggtagggaggcctgcagaccatcttccaaggtgccctgactccacccctccttccaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggcatgtgggtgccggggtgccgggcggccgcctgtgggtgggtgggcggggagcagcgtctggaataggcacgtgggcgccgggatgcgggggcggccgccagtgggtgggcagggagcagcttctggaataggcacgtgggcgctgggtgccagggcggctgcctgtgggtgggcggggagcagcttctggaataggcacgtgggtgccggggtgccgggcggccgcctgtgggtgggcggggagcagcttctggaataggcatgtgggcaccggggtgctgggcggccgcctgtgggtgggcggggagcagcttctggaataggcacgtgggtgctgggtgccagggcggccgcctatgggtgggcggggagcagcttcaggggccagggcgcttttcctgttggatgtgtgagcacttgaggctggagcgggtgagtggccgtgtcagctgataatatggtcctggagggaacccggctggggtctcacactcccagcagcgggcaccatcagatggaggggcctggcttcggcctagtaaccaggctagataaaaagtgatattgtgtcctgcagagagagagcctgccccaccccacccgccaggccgtgctcatcggccctcctggtgaggaagcccacgtccaaccctgctgggcacctgccttccacagagacttagtggctatttacctaaagagattattgaaggaattttcattttactcagccatgaggacaaagggtcttattgaaactgttctaataggcttatgcccagtcacgggtctctcaggtcacatgagcggtggaggcgggagcggccgtatccgaagcagtttcctcctggagctgtggggtccttgtccataaggcacatctgcacaggaagagcctggaaaagcgctctcacaggctgccggcccagctggtcaccccgacaccccatcccagggccctgggcctgctcacctgcccatcccagccgctgaccccgtcctctgctcccacatggctgacgctcggcatgcctcttgttccctgtgtctcctggccggaagccggaccccaaccctcccagaccctagaattgtgaaactgatgtgcagctgaggagtgtgctattgggacagtggaggtgctgcccttcccgcgtgcccagctcagagcaccgtgcggtgtgattgtgtctcgtcccacggccagcactgctaaccgccaggctgggtcactttctaggcgaggacagggtcttgccctggctccggctgtcggtggcggggctggggctggagcggcggagccatctccttgacccctcatgaaatgccttctgctcctggccagtccgtccctctccctgccacccactgaccagatggcatctctgctcttagtggagggccactgtccaccgccaaggttatttataggggtgagcattatgtgtggcgtttcccttaaaataacaaaataagaaaagtctctagagcaaaaatgtttaaatcccatctgcctgccctctcatgttgtacattaacggattaaaaagtagattccagaaattaagccattccaccaggccttggatatcatcagagggacgatgggtgcaggtgctctgcgcacctgccacttggtggggcccccgatctcagcccctctggctgcaggagaggcccggggagagcttcatcacgccctccctcctggggcccgacaagaacttcacgcgggagcaggcacgtgggcgccggggtgcaggggcagccaccagtaggtgggcggggagcagcttcgggggcaagggaggcccagcctgccaggactcgccagcccctgttgttgccaggcttgtgtctaggaagttcacgtaagtggtgtcttgtgacccagctttcgcaagttgctctcctgcccaatctgacttgagagacgttccacgtgggttcgaggctgttcttaagctgcgcctcctgggttgaactacaaggtgcttatctgctgctttgctggaggtgattaggggattccggcttctcccactgcaggtgatggctgcaggtagagcacgagctggcagcctcaggcagtgggccttgacccagctggcccgggctggcacttccagttcactcctggggcgaatgctgcttcctctgcagcctgccacgggctgcccacgttcccctcaccagctcgggtgggctgctgagcgccggccgtctggccgctgtgaggagcgtggtttcctttgctcacatttgctctgccgccatttctcccgccgtgggccagtgtttcctggcagccctgtggttgctgtcctcctcggacctggttcccttttctgcctcctggggaccccgtgcccttgggattggactggttgtgtgttacatacggtgtttctctggagtcattttgaatttggccaaatttccctccagggtttctgctttgagtgtcagctgagagcgctttccccggccgagtccgtgaggtgctcctgggtgcactgaggttgcctgggcccccgctggaactgtgctgtgtggtgggagctgcagcccccgccctcctccagggagaccccccggcccaggaccctgtgcacagcagtccctcctgacctgcggcccatgccccgtccccagccagcccctgttgggtgcccttctgtggcatccagtcctgctgccccacgcctggccctgccctcgcgtcctgcctgccttcgggccttgcccaccttcccgcctccctgttcagagaagccgccctgaggccgtctggacgtagatttgggcgcagctgcctgcactctgcccattcagcctggaccccaaccaagacctgtggagagcagggccgacgctgggctcaggcagcaggaggctgtcctcgtgtcagagtcgtggccgcctgacagatgccacctccctgctgggaccgttgtgagggcccctcccccagcagccttgtaagtgggacgcaggtcacagctctgggcagagcctccctgctgtctgcctgccaaggctgaggaagagggagtaggggccgttgaggaggtgcagggagaggagcgggagggctctgggtggctgccaagggggagctctgcgctcagaccctcaactaagaccaggaggtgcctgatgaggccccagcctgcagagccagctcctggtggaagaggaaatgaggcatgctccattcattcggaggtgggtgaggcttctaggacccctggccgcccttttccagagagccgtggggtctggggagagcctctctgctggctgtctaccattttgactctgggctgtgggcagaacctgtgccccggccaggggctggggctgtcatgcccccacgcagcctcctgtgtctgggggtcgggggtccctgaggtcctaggaggacccctgcctctgagccgcttctttcggaatctgcaggggttccctgggctggccctgaggaggagcctcccccagtcgagcaggccatcagccaggagagcttgcccacagaggggctgtttgatgtccccaggacattgctgtaaacacagtgcagaagccgatggctggccctgaggctctctgtgacccggcgggctcactcagcctcctggcacataacctgccctcagagtgtcccggaatgtcctgagcaggacggagtgccggagggaccttgggtgcctggtgctgctgggaccacagcctttgggtcagcctggcctccatgagggtgcaggctccagggtgcgacctcagggtgccctgaggtggggtctctgggcagccttcccctgagcccctgggaagcttctcagcatgccggcctggctgcagggtcctattgcccagctgttcacagtagccggtggccgggctctgagcacatcgggccacacatcttgggtgtgccagacacgaggctgagagcccccggggaggcggcgtggctcggcgcagcaccccacgtgctgacccagggtttggtcctgccaagtgtggctggcaggggctgaggtcacctggggcagcacgagtggggctgtggggttactggtggtcaggcctgagtcgggtggggcctgctggaggcccagagtccagcagggccctgctggctcatctggtaccaacctccagtggatctgaggtggggtctggtggggcctgtgggcggggccacctgctgaaaatgcacctgggccccaggggaggctccaagcatagggtggctcccacatcagtccccagggaggggcaaggcaagcggcttggcctcacaggggtggggcctcttcctctggactgtgcccaggtgtgcccaggtgtgcccacagcagccctggcccctgccaagacagctgaggacgtttggtgcctgcctgtagtagtctggggcagtgtcctctgaccttgtcctgtaggaggtagcacccccagccccgtgcccagctccacgttcccatggaaggtggatgtgtgttgaggccacaggcatggaagccaggcctggagtgtccaccagcagctcagtggccaaggctgtggagctgggttcccacataacatgtgatggaggaggtgggggtgggcaggctgacagcctgtgctccccctcctgggagggtgcagggcggctacaggggcgtttgcccccctccctgctcctgggttggagtctggccttaaagaccttgctctggggacaagtgtgagatgggagtgcacagcccagggccctctgccctaccccacttcctctctttccccttcttccccttcctgtctttcttcccctgccgggttcccccacgaacagtccctcccacgaacctgctgtccctgatcctgcccttcctttctgtgtcttctgtttttgtctctctccaggaaggatggaagaagcttgtgctggtgtgaatgtgtatgggttacagctgtgttttccatattgtttaaaatgaaataaaaccatgttttgattctattaaaaatagagaagctggctgggtgtggtggctggtgcctgtaatcctagcactttgggaggctaaggtgggcagatcacctgaggtcaggagttcgagaccagcctgcccaacatggtgaaacccccatctctactaaaaatacaaaaattagccagacatggtggtacgcacctgtaatctcagctactcgggaggctgaggcaggagaactgcttgaacctgggaggtggaggttgcaatgagctaagatcgtgccactgcactccagcctgggcgacagagcaagactctgtcccaagaaagagataaaaatagagaagcttagatgaacaggcttgttaataacgattccttctgtggccactgccagctttccgcaggcgaacgctcccaggctgccgggacggtcgggagccagaggtccctgttcagagaggacgatgcagtgggacatgggacaggggcgtgttggggagaggggtcccaccaggcagtgttggggcaggaagccgtcagcagccatcacctcgggcgggctgtgtctgccgcagcggcagcattgctaacacctggtggggcgcacgcccgcctgtccgcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggtacgcatgccctggtccccgaggcttcttcccgcagaggcttcccgtccacctccgcctgccccgtggatccttcccccggaggctccctctcccgccccctgccccatggataccttcccccagaggctctccgccacctccccctgccccgtggatccttcccccggaggctccccctccccgccccctgccccgtggatccttcccccggaggctccccctccccgccccctgccccgtggatccttcccccggaggctccctgccacctccccctgccccgtggatccttccccggaggctccccgtccccgccccctgccccgtggatacctttcctcagaagctcccgctacctccccctgccccgtggccccccagggccgctgcaacgccccatccctcccctctcaggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacgtgagttccagaagggtgggaagccgggggcgggcaggcgccaggatcaagccccgcgcttcgctgggtgctcccaccttcctgctgcgccccagcggctgtgccactgctggccccgccagccacctggagctgaccagggtccccacttgcctctccctgggacctcgggcgtcccttcctgtgccgtcttgctgctcccccaggccctccacgctcctctctgaagcctgctgggctcacagccttgccctgctcccaaccccaccctctaggccccgggctgctgagaccccatccaggcaggagcgggagcttgcacctgtgtgagttcatcctcagcttacactcacaccaggcactcacaccacacacacaccacacgctcacacatggacacacacacactcatgaacacaccacatgcgcacagatggacactcaccacacactcatgaacacataccacacgtgcacacatggacaaacacaccacactcacacatggatatatcgcacatgaacacaccacacacacggacacacaccatgttcacacatggatatatcacacatggacacccactacacatggacgcaccacacacacacggacacacaatgcacactcacatgaacacaccacacgctcacagatggatacaccacacagacacaccacacacgaacacacaccacatgctcacagatggacacccactacactcacatgaatgcatcacatacttacacatggacacacaccacacacacggacacccaccacactcacatgaacacactacatgcttacccatggacacacactacacacggacacacacacactcacagggacacaccacatgttcacagacacccaccacactcacatgaatgcaccatatgcttacacatggacacacaccacacagacacaccacacactcacatggacacaccacacactcacagatggatacaccacactcacatgaacacaccacatgcttacacatggacacagcacacatggacatgctacacgctcagatggacacacaccacacggacacacaacacatgctcacacatggacacacaccacacgttcacacatggacacaccacacgtttacacatggacacgttcacacatggacacacgctcacacatggagacacccacacattgacacactcccaccacatactcagaccacacacactgacacactcagacactgaccctgtgtgctcacagggtcctgctccctggacctgccccctctttcctgcccgctgggaggactttggccccagctcagtaccccttcctgggcttcccctccagggtggcctccgagccctatctccctccctccgtgggtcatccccctgggccttatgctggtcacgagcctgtttgagctgagagcaccctcctgacccttgcattgggccctctgtgtcagtggcctcacccctgcagcatcctgcctggatgtgcccggccctgtacttccccatcctccccacatgcaggcagcagtctcccggcatgggcagcccggcccacccttctctcccgcccctgccatactcggggccccttctgctcctgtgtggccgccttctccaggctccccgaggcccacactgggctcttgccgtccctggctcgtgaaggcccagcgtgatcttgcttgggcccccccactgacctgccagcactgtggaaagggccagggcctctgccattgtgctgtcccattgctgcagccagggggacaacgcctgaaaggttttagttataaagtcattgatgcccatcgcaaaaaaatccaacacggtgccgcagcgtgcaaagcagaaaactgctgtttgctacggggaatcccagcattttctgcttgtctgtgttgggttgatgccagacacagatgcagatggtcactcacagatgcaggtggtcactcccggtcatgagtggtgggccttacaacccatccccagtctatgggtaaagtcaccatttccatttttcttacacgaggaaaacactgagatgaatgcccttctacctacatttttgtttccaaattctaataatgaccctcaggtggattcctggaaggggaatggccaggttggagagtatgtgcttttgaaagcaggtttctgtcaatattgcaggtaccctgcaggccggcatgcgggcttcctccccgtcaggatggtggagtggcctccccaccctccctgagcccctgacgggccggctgggctcccagcctttccttaaccagagtgaggccggccggcctgctgtggactgagtggcccctgtgtgtctcctgactctgttgggactcgctttcctccctgctgatctggggagcattcatctgtatcatgtattttcaatcacctgtgcccccatcacgccccacactcgtctgcctttaattcaactcacagtgtttctgagtgtccttggaagcaccctgggggctggcctgggctctgccctgcccagcgctggcatccagaagctcgtgtttgtgctcagttctccctgttgttcgtctgcccttcatcccactgacctgctcaccgggacctctgtgtgcttctctcgtcctccctgctgccggcctgcctgcctgcccccgagcctccactgtccccactgtccccccgtctccagtgcccagcagcacagacacctctgcccttctccaaagggttcctgggcatttttgtttattttttcttcaggtgaactttaggacattttttgtccagttcttttttttttttttttttaagcactttgcagattttaattggaactgcatcggaagactagtttctttgcagagcaccagaagcctggcgtgtcacctctccatgtcaggaatgtggtgccttcattcctggacatgttcatgccaccgctcacctccagggcccgccctgcctggctgccactcacctccagggcccaccctgccctgctgccactcacctccagggcccgcagtaactgactgccactcacctccagggcccgccctgcctggctgccactcacctccagggcccgcagtaactgactgccactcacctccagggcccgccctgcctggctgccactcacctccagggcccaccctgccctgctgccactcacctccagggcctgcagtaactggctgccactcacctccagggcccgccctgcccggctgccactcacctccagggcccgcagtaactgactgccactcacctccagggcccgccctgcctggctgccactcacctccagggcccaccctgcccgctgccactcacctccagggcccgtcctaacctgctgccactcacctccagggcctgccctgcctggctgcctctcacctcctgggcccaccctgcccgctgccactcacctccagggcctgcccgggcatacccagctgctattcacctccagggcctgccccgcctccaggcccccctcccccccaattgccactcacctccagggccctcccgggcatacccagctgctactcacctccagggcccgctctgcccagctgccactcaactccagggcctgccctgcctggctgctgctcattcaccgactctgtggtttcactgctcttctaatttatcaaacatttaaccgtgaaagactttcattctagacttttctgtctgtgcccagaggttctcttgatgatgattttctgaatgttttgagacgcccgtgacctggtctgtcccagagctcatgggagcccttccaggtatcttctcgagtttgtgttttgtgacacccattgtataggttcagcatccctaatcaaaacagccagaattcagctgggcgcagtggctcacacctgtgatcccagcactttgggaggctgaggtgggtggatcacctgaggccaggagctcgagaccagcctggccaacatggtgaaactctgtctctactaaaaatacaaaaattagctgggcatgatggcgcgtgcctgtaatcccagctactcgaaaggctgagacaggagaattgcttgaacccaggaggcagaggttgcagtgagctgagattgtgccattgcacgcctgggcaacagagcgagactccatctaaaaaaaaataacaaaaaatccagaatttgaaatactccaaaatctgacagtttttgagcaccggaaagacaacccggtggaaaatcctgtacctgaccttgtttgacgagtctcagaacacggtcaaaagtttcttcatgcacaaaattactccagaactcagggtgaggccctgggcagtagcaggcaacccctttggcttgcaaatgtttgtcaggtattatataaaatcaccttctggctgtgtgtgtacagtgcatatgagcataaatgcatttcgtgtttagacttgggttccatcctcaagacatctcattatggacatgtgaatattcccaaatccaaaactactggccccaggcattttggataagggaccctcactctgtactgagccagggggacacggcagctcccagaatggcccctcgagggtggcctgggtgctggctcctgcctggcaggggcgggcatgtgtgggagagatgggggcctggtggggggcttgtgcgtgccctgggaccccgtggctgccgggcgggtcatgggctggtgggagccgggctgcaggcttttccctgtggctgctgcttattctcccagcagcgcctgatctgcccgctcttcccgttcagctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggtgagcccatttcaggcctgcgtcctcggggatggaagctacttgtggggacattgttgaggcctcctggtgcccgcctgatgtggagcccactgtgggctgggggcacagggtgcgggcctggggcttccagtgggacacaccaggccagcgagagcaggaagtgagagagaccctagcggggctcagttgttgtgggcgggagcctccgtcaggccctgggcctcagtgggagcagctgagcctctgctcgccacggcggagctgtccttgtctccgctctctgcctgtggctgccggaacttggtgtccttgagccctggctggaggccacgtgacctttgtcctcttcaggaaggagagctgagcagagccactcagcagtgtcagtgcgcaggcctctgcgggtgccctcccctttcccacctctcgcgggcctctgctgcttctgagaagagctggaaaacacacatttaactcctgagggtcccagccaaggccgggtctccgagtgagctggaatcagccatggtgggcgtggtgtgagaggtccttccaggctcctcaggactgccccagcctgcagctagacagatgcccttggcgggtgggacaagggctttgtccacctggggcccaggtctcactgggcaggaggactgtcagggttagtcctgatcctctgagggtgcggagtctgttcagcttcagtgactccagagctcagggtaaggcccgggcaatagcaggcatccccttcggctcacaaatgcctgttaggtgaggatggctgttgctcactcatcgaaatgcattcttcagcccaagagtgtcattagggcctgtccacgctggcaggccacgtggccctgtgccacagagccctctgggtacaacacccccgacccaggtgtgaacactcagggcgggtgagtctccaaggcccaggggtgaacgcttagggtgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacactcagggcgggtgagcctccgaagcccaggggtgaacgttcagggcaggtgagtctccgaggcccgggggtgaacgctcaggacaggtgagcctccaaggcccaggggtgaacgctcagggtgggtgagcctctgaggcccaggtgtgaacactcagggcgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacactcagggcgggtgagcctccgaagcccaggggtgaacgttcagggcaggtgagtctccgaggcccgggggtgaacgctcaggacaggtgagcctccaaggcccaggggtgaacgctcagggtgggtgagcctctgaggcccaggtgtgaacactcagggcgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacgctcagggcgggtgagcctccgaagcccaggggtgaacgctcaggacaggtgagtctccaaggcccacgggtgaatgtgtccaggcccggcctgggtggacacagcctcctggtggccgggctggtctcaggtctgcagaaagggggcccagaaggcttctgttgaatgcatggccccagggcggggtgctggcagcagtccagctggctttggaggggctccagcacccgggaggaggtcctccccattcttggagccccgagttacctctgtccccagacagcagtggctgccagcatgtatgggcagggagtgcccgtcccagggagaccctcagggccctgtgtggccccagccaggctggaactggcttctgacctgcctctgggtgctgactgcccctgactaccgttgccgccccacctccatccctctgtgactgcctcttgttcagcccttggcagctggaggggcagatgcctgagggctctttagggactctgtgcgtgtgctcccctgtagctgccctgtggaggggacccctcacggtgggcttctaagggcccatgggggcttggtgcagggggtggagcagttcttccccagagagctggtcacgaggaagccctttcccttccttagctggtcctggtcctggtgtggccgtggaggctgtgggggagacagctctggggaggtggaggcaggttctggcctgtggttcctggctgcctcttgtcacatagaaaaaaaacacatggacttttctctggctggtttgatttctaggttaaaaagttaactagtggggcattttgctcatggctggacatcctgttgggtctagaggaggtggtgcgggctcatcttgcccccgtgcctgttactgggtgccgagtgtccactctctttcctccagcatggggagaacagctgggccaggagttcaggcttggtcgggggtagagtctggagacgggagggagccgtgatggagcatggggggacagacagggctagagcttgcctgggtttgcctgctttttaaattaagctttatatttgggtaatcttatattcacatgctgtttaataaataatacagggagatccatgtaccccgtacccagttttcacagtggtcacgtcttacagttctgtagcacatcacaaccagcatggcgacagtcaggatccagaacattctatccccacagggatccctcatgctgctctttatagccaaggcccaccctactcccagcctcacgtcctctttaacccctggcagccactaccctcttctccgcttgtatgagtttgtcatttcaggagtgttgtataaacacggctatgcattgtgtatcgtttagggattggctcttttcactcaacactgttctctgaacattcatccatgttgttactgtggctgtggctgattccttcttgctgctgagtgctgttccagggtgtaggtacagcacactttatttattcaccgttgaaagacttgtttccagtgtgaggtattaccaataaagctgctatggacattcttttataggtttttgtgtgaatataggttttcctttccctgggacagacgcccagaagtgcaagtgctgggtcaccaggtagttgcttgtttctttccaggaaagaagcagggaagcagcccactttccatagcagtcgtaccgttttatatcaccaccagcagactttgagagatccagtcacagcgtctttggtatgccgtgttgccactagtttttattttggccgttgtgataggtgtagtgatatttcattgtggttttaatttgcatttccctggggcataatattgttttaatttgcatttccctggtggataatgatgttgaacatctttttatgtccttattttccatttgcaaaatcttcacatcttctgcccattttctcattggattgttcatttttatactcttgagttttaagcatggtttgtgtattccagatattagtcctttgttggatatatacagtttgcaatttttttttcaactctgtagctggttgtttcatctacttaatgtggtcttttacagaacaagtgttttttaactcccatgagctctgatttaacagtttttccttttatggaaactctttgcctagccctaaattcagaagattttcctcaaatttcttttttaaagtttcgtgtttttacatttaagtctctgaccagctttaatttttgtataagatgtgaagtttaggttgaggtcactttttttttggcctgtgcgtatccatttattccagcatcatttgttgaaaagacttagctctccccattgaattacttttgcacctttgtcaaaagttgggcatatttatgtgagtctgtttctgggttttttatcctgttccattgaactatgtgtttactcttgtaccaatatcacactgtcttggttatgaagctttacagcaagttttgaaagtggatagacttgattcctccaacttctttttattcaaaattgttttgactattatagtttctttgcctttccgtatacattttagagtaatcttgtctatatctacaaaaattcctgctcagattttgttaggaattgcaattaagccagtgtatcaattttgggagaattgacgtgtttactgtgttgttttccaatccatgaacatggtatatctttccatttatttagatctttgatttctttcagcattttgtagttttcagcatatgagtactatacatgtttttagtttatgctttttcttaagtaaatcaaaccatattttgaaatttgttatctgcattagtctgtttgggctgccatagcaaaatatcacaaactgggtgacaaacaacagaaatatattctctcacagttccggaggcttgaagtctgagattaaggtgttggcaggttggtttctcctgatgcctctcttcttggcttgcagttggcatcttctccctttgtcttcatatggtcttttttttctgtgtatggtcctccctggtatctttttttcgtttgttttttttttttttgagatggagtttcgctcttgttgcccaggctggagtgcaatggcgcaatctcagctcaccgcaacctcctcctcctgggttcaagcaattctcctgtctcagcctcccaagtagctgggattacaggcatgtgccaccatgcctggctaatttcatgtttttagtagagacggggtttctccatgttggccaggctagtcttgaactctggacctcaggtgatccacccgcctcagcctcccaaagtgctggggttacaggcatgagccaccatgcccggctagtgtctgtcttcttataaggacatccagtcaggttggagtaagatgccatccttgtgacctcatttaaccgtaattaccttttgaaaggccctgtcttcaaatgcagtgacattgtgggttagggcttcaacatatgaattgggtgatgggttcacaattcattccataacagtgtatacatgttcgttgctagtgtatagaaatgtagttgatatatttgtgtgtttatcttgtatactgcaattttgctgagattacttatttgttgtaggaggcttttccattttttggcctttgttttttaaattccttgagattttctacgtagataattatgtcatctgcaaatatttcttcctttctgatctgtatatcttttatttctttttcttgacttagtgcactggctggaactttattaattccttctttctgcttgctttagatttattttgctcttcttttttctaggttcttgaggtgagatattgatttgagacttttcctcttttctaatttatgcatctaatgctataaatttccccactcagtactgctttagttgcatcccacaaatcttaataggctgtgttttcattttcattcatttcagtgtgttttttgatgcatcattatttcaaattttgttgtttaatttccaagtgttttgagattttcctgttatctttctgttattaatttcttttttgattctgttgtgattggaaaacacattattatttcagtccttataaatttgttaagatttgtcttatgacccagaatattatctgttttgatatactgtggacactttgaaagaatgtatattctgcttttgggtggagtgttctgtaaatgctgatcagatcctgttggctgatggtattgatttcctctcagttcttgtggattttctgtctagttttattattgagagggggtattgaagtctcctaagtataattgtggatctgtttctcctttcagttctgttgtgtttttgcttcacatattggcagctcttttgtttgttgcatacacgttagggattgaaatttgttttggtggactgaccctcttgtcaattgtgtaatagtgggattatataatgtccttctctgtctctgctgtccctggtcttttttttttttttttttttttttgctcagaagtttattttacctgatgttaatatagccacccctgctttcctttgattaatgttcacatgatacatctttttccatcgttttactttcaaccttcctatcttggtatatttgaagtgagtttcttgtagacagcacgtagttgagtcatgtttttaaatcgactttgctaatctctgtcttacagttggtgtatttagaccatttatatttaatgtgataatttgtatattagggcctaagtctgccatttcgtttttaatttttcatttattctctgtttttagtttctgtttacattttttgcagcttccagtgggttacttgtacatcctttagaattttgtttggtttatctattgtgtttttgaatgtacttagtatagcttttttggttgctttatggattacattaatacataaagtttgagtgaagtataaaaacgttgcctttatgtcactgtcatctcccgcttacagtacaattatcttaaatattttctctacatacctttagtgctacataagaaaatattgtaatttttgcattaatcatcaaacatattttaggaaactaaagaaggaaagtctgttttatttacccataatgttgcctactgtggtatttcctctttcctgttatttcaagattccttctttagtaatttcctttctgtttagagaacttgttttttgtttgttttttgccattattttagacagatctgctggttacaaatttcttctcttagtttttcttcatctgtgagtgtcttgattgctcttttattctcaaaggatgttttcactggatataggatgctgggtagacagtgttctttttttttagcctgtgagaaatgtggtgccccttcctcatagctttcaggatttttgatgagcaattactgttattcaaattgcttgcccgtaaagtgtcatttttctctggccacttccaagattttttctttatttttatcgttagcttatagaagtttgaatatggtatgtgttggtgtgattttgtttgggttttctatttggggtttgctcagcttcatgaatctgcagtgtacatctcaccaaatttaggaagttttcaaccattatttcctgaaatgctttttgaaccccactccttttctcctctttttctagatcccccatgtcacaaatgttagatcatgttgtatagtcccacaaggaatgaggctttgttcattttttttcagtccattttttcttttgttcaggttggataatttctattgttctacctccagttcattgatcatttctctgcctcttctattttgttgttgagatgattcattaagtttttaaattctgattattgtacatttcagttctaaattttttttatttctcctatttctttgctgagactgtgttttttcatttgtttccagcatgtttgttattgttcactgaagcatttttatggtggctgctttaagatctttcttggcgaattctactgtctgtgttgtcttagtgttggtgtctattaattgtttttcagtttgagatctttgtggtttagtgtgccaagggattttttagtgagatgcaagcattttgggtatgatgtaatttcagcatcctgttgtggctgacgcaactcctgcaggtcaagcggggtgtgcacctcgctacaggcaggtggggtggaagtccaggctctcactcagcctttgtgacacctgagggagggtgggtggctgggtgggggctccttcttgttgccaggcaaggatgggagtccagctcccctcgtggcccccttgatgcccctggggttgggacattctcattattgctgggtaggtgaaagtctggactcccgcttgacctcctctgacaccccccagcatggagggggacaggacaggcacgctcttactactgggtgaggataagaggccaggctccccatatggtctctgctgactccgtgaggcttcgggggtgactaggctccccacatggtctccactgactccatgaggctttgggggtgacatcttgggcttccctgtggtctctgctgactccttgggggtgagggtgggtgtctttaccaaccagtgggagtgaaagctctagtgcccactggtgttgtctgacaccaccccgcaggggactcgggggtccttgttacaggctggcgagggtggggggtccttgctgacatggtgggtggagccgaggtctggtgtttgcggggagcagggcgattcctgtcgaaaggtctttcctcatgttgggctgacccttccctgggtcttaggccagagagagctgcttccatgggctcttttttctgcatctgttgtcttttccagcctgctgccttcttcagtttcaaaatatctgaggtgaaaagaaaagcccccagggagctctgcgtggcacagtctgtccttgcgtggcacagctccccagaccccgagggcccggccagtctgcccttgtgtggcacagctccccagaccccgagggcctggtcagtctgtcctcctcgctcctgctttcagagtcttcccaggtgtttatctcagtgtcttgggtaggagaagagcagggagaagcgtgtcagccccatcttcctcagtttgctttaaaaacagctgtcctggaagggtgccggtgccgatgggctgcagggattctggcctgcggatgtggagctggggcctcaggggtcttgggcgggactcactgggctctgcccacggatgtcctgagggcactgcagcctcctgaaccctctgcacctccgggaatgatcaggtccctccctggtgtcccagggacatctccagtccctcctgcccctggcagctgcgagaatcaggagagatgtggccaacgctggtgctgctccttctggtcatcgtagcacagcttccgctgccgagatggagacgggctccatgtgcaggctgctgggggttgctctgggcgcgaagccctggggatcagctcctggtcacctgctgtggctctcctcaccctgctctgccaggcgggacgttctggccctcatgggcacccttccgctgtctcagcaccatgggggggcagcaagcaccaccaagcaggggactcgggagcagacaccgcaggccacgcagaagcaggccacctgccaggttccgaggggttcttgggaaatggtgggaaccccccttcaggcctgtgccaggtggtggaggtcgggggggctgtggtgagcactgtggcacctgctcctggggctggcctctgaccgctgtgcagtgttcagggtcagcctctgagctggaggagggtgagcctgggagcaggcgtcggggtgtagggtgccagtgtcccagccaggccctccccacccgcctcacccggcctctctttccagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 37530 - DNA, 84648 bp, Homo sapiens; identical to SEQ ID NO: 37267

SEQ ID NO: 37531 - DNA, 232512 bp, Homo sapiens
taggcaggcggctgagccggcggcgggtggcctgcccaacgtgtgctgggtgggagaaggcgaggcgtcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggtagggcgggttgggatccgggagggtgaacctgaatggaagccgtgggggaggggatcttcggcgggaggacccgggctggagctttggaggggtggggtctgagtagttcgcggggaggagtgggaggtctggggaggccgagaaatggggagtggagaaatggaagtggtggcctggggttgtattggaaatgggggtgtagaagaatgaaaaattggtgcaagagatagtcaggggttctggatggggcgaaaggacgctggaatgtgggctgagtgtgtgagctgcaacgagtaggcttactaaagaggcgttgaggagttatccataggagtaaatagagtaagatgtaagtcaatttgatgtagtgttatcctgttttctagaggttgtccttaaaattgtaaaaacggatgacactcccaagcattctctgatttggccatcattatacttttgtaccagtgtgttcacaatcattgttaaggctctctttaccaaccatctatttcacaagaaagcacttgtgaaacacctgcatgtgagcagtgttaagcccaattttgtgaacagaattcgtagatatatggtttgcctgctagttttccactgaaaacacattactgggaaaacacagcagcatacaaatattcatggagtttctgaatgaacaggatatgtttatgtaatttattagtcaagagtaggtgtatttatgagtaggggataaaggtcagttttatcaggcaggagaagctgccactagtagcggtaataagtttagtgaaaggagaataagtaatccttggtcttgttggatttacagaaaaatgttctgtagtaatgaactctagtgacagctttccttttgttcagctctattcgggatcctactgacttcatccatgaatgttttaagacttcttataggtctcttacctcttttctctcagataaattagcattttccttagacatttttttttttttttgagacgaagtctcgctctgtcgcccaggggagagtgcagtggcattatttcggctcactgcaacctccacctcctgggttcagcgattctcctgcctcagcctcccggctagctgggattacaggtgcctaccaccatgtccagctaatttttttgtatttttagcagagacagggtttcaccatgttggccaggctggtctggaactctgacctcaggtaatcgggattacaggcatgagccagtgtgcccggccctttagacagtttaaaaattatataccatgctaggtagcccttggacttttccccccttttgttcttccacctcttattccccactgagccctgaggagactgcaccattgaccatctctgccccgcttctagctgctgagcattgtcctcttgctgcaatttactcccccatgtgcctaatacttatcttttacattctctgcagtatcatctagtcaaaacttgtacaatgaacttcaagtccaggtcctttcctgtctcagtttacctgtccagttgaccttactgcgtatttcatggtagagttcaagattacttgatttttccctcctctttattttatgatttttgtgttttctcatccttagcttcagtctcagagaaaagtactcatcctcctctccgaggctaatttctctacttatgtccttgatttcatcctcttttgtttgccttagacccttgttactctctttgttttatatcacaaataaaaacaaaacaacataatttccctgaattgtgtaacctacccaaactactttgttatctcttctttgcttccccaacaaccttcttgaaaaatgagtttgtattcagtgtcttagcttcctcaccttgtatacatttctaatatggtttggcttcttcacttatgctttcccaaaactgatgtctttaaggtcaccgaaagctttttttgtgtgggattacttttttattgaggtttgacaaatcaaaggttcattcagtccatgaaatattacagaatgagtacctgtatgatcacaactcacatcaggatggagaacattcccagtaccctagaatgctccctgtgctttctcctagcactactcttttacagatgtaacctccctcaccacctctgtcactatagatttgttttgaactaatacttcatataaatggaatcatagtgtgtactgttttgtgaccagattctttcattcggatcatgtcttgagactcatccatgttgttgcttgtagaaacagttctttttcattgctgtgtaattttccattgtatgaatgtattgtgatggttactaaaacttatttttgtttttgagacaggatctcactctgtcacccacgctggagtgtagtggtgccgtcatagctcacggcagccttgaactcccaggctcaagtgatcctcctgcctcagcctcccaagtagctgggaccataggcacataccaccatgcccagctaattttttaatttctttttctttttctttttgagacagagtcttgctctctcgcccaggctggagtgcagcggcacattctcagctcactgcaacctctgcctcccggattcaagcgattctcttgcctcagcctcccgagtagctgggattacaggcatgcaccaccatgcctggctaattctctatttttagtggagatggggtttcaccatgttggccaggctagtcacgagctcctaacctcagatgatctgcccgccttggcctcccaaagtgctgggattacaggcgtgaactaccacggcctaattttttattttttgtagaggtggtatcttaccatgttgctcaggctagcctcgaactcctgggctcaagtgattctcccaccttgacctcccaaagtgctgggattatgggcatgagtgcccagtttgtttttcaaattgaaatataattcatggctacttgtgaaaagttttcattgtgaaatagttacagagagaaatatgtaaaagtcctgggaacctttaaattactaaatctgatagtcttttcctcatcttgtctgacctctgtgaactatttgtcactgttgactgtgtgttccttgttgacatttttttcttttttaatattataatatccattctgttactgcttctctaactgctctcttgtgtgtctttgtcttgtgttttctcttcctgttcctgaaatgttccttgaggacatgtcctctgtccttagcttgatcctttattgtgctctatttagcaggctcattctgtttgtagatgttgaggatgtagaacaagggtctgcagtcctctttatttatggcattgtgtcacagaacatccttgtaaagtgagctgagtctctttaggtgtgacctctttccttagctctacatttccatttttgtgcttaacatttccaccgtagactcatcatttgtgttcttaacatttgtgatttttttttttttttgagacagggtctcactttgttgcccaggctggagtgcagtggtgggacctcagctcactgcaaccttcgcctcccaggctcaagtgattctccagcttcagcctccccagtagctgggattgcaggcgtccgccaccacgcctggctaatttttgtatttttagtagagacggggtttcaccatgttggccaggctgatctcgaactcctgacctcaggtgatccacccacctcggcctcccaaagtgctgggattacaggtgtgagccactgtgcccggcctaacatttgtgagttttataatttgatagtgaccttgaaagttcataatttgtaataatttatgattttaaaaaggccaaaattttcattgtatgtgtcgagactggttgaattctatttatttgggtagtaagagcccagctgatcagcaagcatctacatctcacacgtaacttttttttccctttctcatgacatggaacagtgcttgttacagtttttattatactagtatttaagaatacgttctaatcaggatgtaggacttggatctccagaaggtcagtggtttactgtatcatgaaaatagaataatttctgtgttgaaatgtgcttctctctgtatctttcctttttgtcatccaacatgaaattatatccatggctttttttgtttgttttattttgagatggagtcttgctctgtcgcccaggctggagtgcagtggcgcgatctcggcttattgtaacctctgcctcccaggttcaagcgtttctcctgtctcagcctcctgagtagcgcatgcctggctaattttttgtatttagtagagatggggtttcactgtgttgcccaggctggtctcgaactcctgagctcaggcaatccacccgccttggcctcccaaagtattaggattacaggcgtgagccaccgtgcctggcccacatctgtagtcttttacttcttctcctttgactcccttagccagtctggcattaggttctctcgattctgccttcatgaaatctttcaaaccattattcccattgtcactaccttaatttcatatttataaactttagtcttggttgttgcagtatcttaactgtatttactcagtcttcagtctcttaacctctaatatatttcacgttctattaacaaaagattggaactcattgcctccctggctaatggtaagtgctttataaatactcgttaaatgttcatttcatttctccttattcatataccttcattagcttcttattacccatagaattaagcctgaagaccttggcattcaagatctacttgatacttagcactttttgttagaagagtcagttagttgccacttctcttggttccttaggaccgtctgcttttctcgatcatggcatacaatattaaaattatcttgtttctctcattagtaagttctttgagagtcagactgttccatttacttctgtatacctagggcttagtatagtacttgaaacatagttatttgtgtatttattagaaacatagatatttgctcaatgtcctaattgattgtaagtcagtcaaatgaattcctctgaggctgtcttaatcatcatggtatcttcagcctctagtattttaactggtatgtaatagacattcagtaagtaattgtttattgttaggcactttgatatactttaattagtcatcagtttgagaagctctttattctctgcttccgcatattaaaattctactcagttttccaggcctaactcaaatgccacagaaacttctgtgaggccaggtgtggtggctcatacttgtaatcccagcactttgggaggttgagcaggcgggttgcttgagctcaggagtttgagaccagactgagcaacatggtgaaaccccatctctacaaaaaatacaaaaattagtcggggttggtggtgcgcgcctgtgggcccagctacttgggaggctgaggtgggacccctggaagttgaggctgcagtgagccaaggttgtaccactgcactccagtctgggtgacagaatgagaccgtgtctcgtaaagaaagcaaaaaacaaacaaacaaaaaacaaaaacaaaaccacacacccaaaaagaaactcttctgcaaagttgtttttccacatgggatcctaggaggatccttaattgggcttcaggaaatctgtgaatgtcctgaaattccagttctcaaaattctgtggtttaaaagtgaaagcttaggttccaagagatcaaatgcaaaaatgactggaaagcacataataagtaggtgcttaataagtagtcttatctcattttgtttctgtaacatattgtttgatccattcctggtcatataaagtagatgctgaataaatatttgctgaatgaaaggatgaatcagtgttttagcactttcaactttctgtgttcatttgtatttcatttttgcttttaagttgcatgttattgaaggtaagaactatgtcatcattttgtctaacaatgcagagctaaaggctttgctcacaataggtgctcagtcattatttattgaatgaatgaatggagaatgattcaaatattttgaattttggtaatttgagtaataatggttatatgataggagtagacaaaggaaatagaatatttttgaggatggcagaagatgagttcaactttagttcctaaaataccctcagtgtgacagaaattttaaaaaattattttaatggaaatcagaacctctttcctctgcattacagggttagtacattgggaaaagcatagggcagaaagcacacagaagggaagctgcgtaatatatatagggaactataatcggtttgttattgccagacccagagctttacgttgaaggtgtaaatgctaggttagagattaaagaagccttgattgttgagggtctttagtgtgatataaaaggataattggctgggtgtggtggctcacgcctgtaatcccagcactttgggagaccaaggtgggtggatcacctaaggttaggagtttgagaccagcctggccaacatgatgaaaccccatctctactaaaaatacaaaaatagccaggcgtcttggtgggcgcctgtaatcccagctacttgggaggctgaggcaggagaattgcttgaacccgggaggtggaggttgcggtgagccaagatcgcgccacggtactccatcctgggcgacagagcgagactccatctcaaaaaaaaaaaaaaaaaaaggataataagtaggggagcagtatattctttttttttttttttgaggcagtcttgctctgtggcccaggctggagtgcagtggcacgatctcagctcaccgcaacttccacctcccaggttcaagctattctcctgcctcagcctcccaagtagctgggattacaggcattggccaccatgcctggctaattttgtattttagtagagacggagtttttccatgttggtcaggctggtctcaaactcccgacctcaagtgatccacctggctcggcctctcaaagtgttgggattacaggcgtgggccaccgtgcctagccgagagcagtatatttctttttttttttttttttgagacgaagtctcgctcttgtctcccaggctggagtgcgatggcacgatctcggctcactgcagcctccccctgtggggttcaagcaattctcctgcctcagcctctcgagtacctgggatgccaccacgcccagctaatttttgtatttttgtattttttttttttttttttgagacggagtcacgctctgtcgcccagactcgagtgcagtggcgcgatctcggctcactgcaagctccgcctcccgggttcgcgccattctcttgcctcagcctctggagtagctgggactacaggcgcccaccaccacgctcggctaatttttttgtatttttagtagagacggggtttcactatgttagtcaggatggtctcgatctcctgacctcgtgatctgccctccttggcctcccaaagtgctgggattataggcgtgagccaccgcacccggcttttttttttttttgacacagagtctcactttgtcacccaggctggagtgcagtggcctgatcttggctcactgcaagctctgcctcccgggttcccgccgttctcctgcctcagcctcccgaatagctgggactacaggcgcccgccaccacgcccagctaatttttttgtatttttagtagagacggggtttcactgtgttagccaggatggtcttgatctcctgacctcgtgatccgcctgtctcggcctcccaaagtgctaggattacaggcgtgagccactgcgcctggcctaatttttgtatttttagtaaagatggggtttcaccatgttggccaggctggtctggacctcctgacctcaggtgatctgcccgccttggcctcccaaaatgctggaattacaggtgtgagccaccgcgcgcggcacaggagcagtatattcttatttgtgttttagttggattactctggcaactgtgtggaggataggatgcaggacatgctgtttgagacatgagcatttgagaaatcttccgagttttcagtgcaaaagtttatttgacctcctttccctcttatccagggtatgggtaagggctagctcctaaaaaggtgttaactttgaaatatttagtttcatcaaaagtactgggagcagagagtctatggtggcttgaagcaggttggcaaatgttccctgatgagggtaggacacatgtgattacagagttttcccatcattgttctggatgtctcttggcctaaagatcaatctgtaagcctttttttttttttttttttttagacggagtctcgcactgttgcccgggctggagtacagtggtaccatcttggctcactgcaacctccgcctcccaggttcaagtgattctcctgcctcagcctcccagtagctgggattacaggcatgtgccaccacgcctgggtaattttgtatttttagtagagactaggtttctccatgttggtcaggctgtctcaaactctcgacctcaggtgatccgtccacctcggcctcccaaagtgctgggattacaagcatcggccactgtgcctggccctactcctatttttaatagtccgtgtaacattttcatttggatagctcagagacctctcaaacttaacatgtccaaaaatgaagtcttgattttcactttctagtctgcttcttccccagtctgcctcatgtcaatagatggcactactcatttaccagaacaaaactggaggttgtgtttgatttttttcttaaccttacctgtattccacattcagcccctcaggtctgtttgctgctacagttgtccctcaatatctctcggggattgagtacatgaccccctgcagataccaaactctggtatgctcaagttctatctataaaatggcatagtatttgcatgtaacctatgtatatcctcccatgtactttaaatcatctccagattatttataatatataatacaatgtaaatgctatgtaaataactgttacactctattacttagggaatagtgacaagaaaaaaatatctatacatgttcagtatagatggaactattcattttctttttctctgcatacagtcatgttccgcataattatgttttagtcaatgatggatgacatacaagatgggggtcccataagattattattattattatcattttttttttgagaccgagtcttgctctgttgctcaggctggagtgcagtggtgcgatctcagctcactggaacctctgcctcctgggttcaagcaattctcctgcctcagcctcccaagtaactaggattacaggcagccgccaccacgcctggccaatttttttttttttttttttgagacgaagttttgctcttgtcccccagtctggagtgcagtggcacgatcttggctcactgcaacctctgccttccggattcaaacaattcttctgcctcagcctcccgagtagctgggattacaggcttctgccaccacacctggctaatttttatatttttagtagagacagtgtttcaccatgttggccaggctggtctcgaacttctgacgtcaggtgagccgcccacctcggcctcccaaagtactgggattataggcatgaaccactgcgcctggccagattataatttttttattaaaatttttttttaaatagagatgaagtcttgctatgttgcccaggctggtcttgagctcttggcctcaagcaatccttctgccttggccttccaaaatgttgggattataagcatgaactattatgcctggcttcccataagattataacagagttgaaaaatttctattgcctagtgacatctagctattacaacattgtagtgcaacacattacatgttcatggtaatgcctgtgtaaaacctactgcactgctgtggtataaaggtacagcacatagagttagtgcatgcacagcacataatacctaatgatgataatatacaactatgttacttgcttatgtatttaccatactatactttctactgttattttagagtgtacccctacttattaaaaaaaaaagttaactgtaaaacagcctcagacaagtccttcagtgtaattccagggaaggcattgttaccataggagatgacagctccatgtcacctccattattgctccattattgcccctgaataccttcccatggaacaagatgtggaggtggaagacagtgatattgatgatctcgaccctgtgtaggcctaggctagtgcgtatgtttgtatcttactttctaacaaaacagtttaaaaagtaaaaaaagaaaatttttttaatagaagaaagcttatataataaggataatgaaagaaaatattttgtataatgtaaacacatacaccaaggcgggtgtatcacctgaggtcaggagtttgagaccagcctggcaaacatggcaaaaccccgtcactactaaaaatacaaaaattagcccagcgtggtggcgcacgcctatagttccagctacttgggaggctgaggcaggagaattgcttgaacccgggagttggaggttgcagtgagccaagatcacgccattgcactccagcctgggcgacaagagcgaaactctatctcaaaaataaaaagaaaaagctatcttgacctttgatttgttggtgttattaaactgttcttttattttattcagcttgaaaggagactttaatttgtgcattttccccttcagggaaacttttatggatttttttattaagtaactggcttagaagatagaatagtctccctaggttttagaatgtaattaagaaaaattcagcccaagggaaccatgtgttaaaattaggtgataccatcttagttgtaccagcttgagtgtaggttccttaagagtgaacctgagtagtagatgcatatatcctttaaccattaatttgttggagattaataagctacatcgtttctttgccgttatttcagcaaagcagaagtaatatagttttgtcagatcttctttttttttttttttgaaactgtctcccagtctggagtgcaatggcgtgatctcggttcactgcaacctctgcctcccaggttcaagtgattctcctgtctcagcctcctgagtagctaggactacaggcacatgccatcacacccagctaatttttatgtttttagtagagatggggtttcaccatgttgggcaggctagtcttgaactcctgacctcaggtgatccaccctcctcagcctccctaagtgctgggattacaggtgtgagccaccgtgactggtcagactttctatctgttaggctttcaggaatgttttgaaaagcagaggatttagaaatagttgttaatagtttttttttaaagtccttaagttatttcataggggtgttaccaaggtgatttttgtttaaatgacccaggaacatttaagttctacctttaaccagtaagagaaagtgatactttgtgactagctcagtctttggtcttttatattaaagaacattacttgctgtaactgattcacaaggaccccttgattgaggtgcttccattttctacacatggcttccaagttcagctgaggaaagtggaggatgggccaatcctagaaatggattaatcacttccactcatattccattgccagaactcagtttcagggccatgcctaactactggagggctgggaaatgtcatgtggcctgtgcctaggaggaaggtgaatcatgcttgatcaacatctaactagtccctgccacaggactcaaaccccaatgtagtccttagcttagaaccatacagaaatccatttattttggttatagacagcctggaaccatagcctcctctttttccttgtagacacacagagttttgagttataacaattttgaatgcaagtaaaggcctttttcccaagcacagataggagatctggaaaagcttttctgcagcctgtggcagaggtagtctctggcaaccccaagaaaggcagcttggtattgggggtgggggggagagagagagagaaagagagagagagagagagagagacccaagtcccttcaaatacctggaaagtcttcccaagaataacagatgcaaacaagcccagatcgcaaaggctacaatgtatatttaactcttcaatgcccagacactgacaaatacccacaagcgttaagaccattcaggaaaacatgacatcaccaaacaaactacgtaaggcaccagggaccaatcctggagagatagagatacatgacctttcagacagagaattcaaaatacccattttgaggaaattcagagaaatacaggataacacagataaggaaatcagaatcccctaaggtaacttcagcaaagaaatggaaataattaaaaagaaccaagctgaaattttggagttgaaaaatgcagttgatatactaaggaatgcatcagagtcctttaatagcagaactgattaagcagaagaaagaatttatttatttatttattttttgagatggagtctcgctctgttgcccaggctgtagtgcagtggcgtaatggctccctgcaacctctgcctcccaggttcaagcgattctcctggctcagcctcccaagtagctgggattacaggtgtgtgccaccacacctggctaatttttttgttttttagtagagacggggtttcaccgtgtcaaccaggatggtctcgatctcctgacctcgtgatccacctgcctcggcttcccaaagtgttgggattacaggcgtgagccacagtgcctggccccagaagaaagaattagtgagctcgaagacaggctatttgaaaatacacagccagaggagacaaaagaagaaaaagataaaaaggaataaaaagcatgcctacaagatctagaaaatagcctccaaaaggcaaatctaagcgttttggccttaaagaggaggtagagagataggggtagaaagtttatcgaaatgaataacaacagagaacttcccaaacttagagaaagatttctatattcaagtataaggttctagaatgccaagcagatttagcccaaagaagactatctcaaggcatttaataatcaaacttctaaaggtaaaagatgaaggatcctaaaagcagtaagagaaaaaacacaaataacatacaatggagcttcaatatgtctgggaccagacttttcagtggaaaccccttacaggccaagagagagaggcatgacatatttaaagtgctgaaggaaaaaacttctaccctagaatagtatatctggtgaaaatattcttcaaacatgaaggagaaataacgacttcataagacagagaagtcgagtaatttcatcaacaccagacctgtcccacacaaatgctaaagggagttcttcaatctgaaagaaaaggatgttaatgagcaataagaaatcatctgaaggtacaaaactgactggtaatagtaagtacacagaaaaacacagaatactatattaataacaataattatggtgtataaacgactcatatcatgaaaagatgaattgatcaagaataataactacaacaacttttccagacatagtatggtattaggttgttgcaaaagtaattgtggttttggactgtgaattttaaatcattataactaggctcaaacacatctttattaatcaaaataggaaccattacaatcaacacattttcgccaatgagaaatgtttgttcttgttgtgtaaaaatccatgctttgggatttgacgaactcttggaaagaatgttctgcatcctgctggtcatggaaatgttttctctgcaaaacgttgtcgagatgcttgaagaagtggtagttggttggtgagaggttaggtgaatatggcgggagggaaaacttcatagcccaattcgttcacttgttgaagcttggttgtgtgatgtgcagttgggtgttgttgtggagaattgggtcctttttgttgaccaatgctggtgtcaggcgttgcagtttttggtgcatctcattaagattgctgagcatacttctcagatgttatgctttcactggggttcagaaagctgtagtggatcagactgacagcagaccaccaaacagtgaccgtgacctttatttgatgcaagtttggctttgggaagtgctttggagcttcttctcagtccagccactgagctggttgtcacaggttgtcatataaagtccacttttccttgcatgtcacagtgtgatcgagaagtggttcattgttctgtagaataagagaagatgacacttcaaaatgatgattatttgattttcactcagctcatgaggcacccacttaacgagctttttcaccttttcgatttgcttcaaatgctgaatgactgtaggatggtcgatgttgagttcttcggcaacttcttgtgtagttctaagagatgattgctcacaattggtcgttgtgaacttccgatggtcggccactacactcctcaccttcaaggcttgcctcctttgcaaaactttttgaaccaccactgcactgtacagttgttagcagttcctctccaaatgcattgttgatgttgtgagttgtctcctttgctttacgacccattttgaacttattcaaaaattgctcatatttgctttttatctaacttcattcccatagtctaaaacataaacagcaagtaaataagtctctagccaaaaaacataaaaaatgaacattaaaatgatgtataatataatgacatttatttaagaatgtattccaagaccgggcatagtggctcatgcctgtaatcccagcactttgggaggctgaggtgggtggatcaccagagttcaggagttcgagaccagcctgaccaacatggtgaaaccttgtctctactaaaaatacaaacttagccaggcatggtggcacacacctgtaatcccagctacttgggaggctgaggcaggagaatcgcttgaacccaggaggcagaggttgcagtgagccgagatcatgccattgcactccagactgggcaacaagagcaaagtctgtctcaaaaaaaaaaaaaaaaagaatgtattccaatatcagatgacaaattctaatcatgcaaaccaccgcaattacgtttgtaccaacctagtagtactggaagtcttaactatggtaattagacaagaaaaagaaataaagggtatccaaattggaaaagaagtcaaattatccttgtttgcagatgatttgatcttatatttggcaaaagcttaaagacttcaccaaaaaactattagaactgataaatttagtaaagttgcaggatccaaagtcaacacacagagatcagtagtgtttctgtatgccaacagtgaacaatctgaaaaaatcaaaaaagtaaccccatttacagtagctgcaaataaaatacctagggattaaccaaagagatgaaagatctctctaatgaaaactattaaacactgatgcaagaaattgaagaggacattaaaaaaatgaaaagatatttcatgttcatggattggaaaaatcactattaaaatgtccatagtacccaaagcaatctacagattcaatacaatccatattcaaaataccaatgacattctccacaaaaatagaaaaaacaattctaaaatttacgtggaaccacagaggactcagaatagccaaagctatcttcaacataaagaagaaaactggagaaatgacattacctgacttgaaatgatactagaaagctatggtaaccaaaacaacatggtactgacataaaaacaaacagagaccaatagaacggaatagagaacccattaataaatccatacatttacagtgaactggtttttgacagaggtgccaagaacatactttggtaaaaggacagtctgtacaataaatggttctcggaaaactggaaatctatatgcagatatctacatgcagaagagtgaaactagatccctatctcttcccatatacaaaaatcaaaaatgtattaaagatttaaatcttaaactgcaaactctgaaactactaaaagaaaactttggggaaacttgctaggacattggtttgggcaaaaatttcttgagcaataaataccccacatgcagaggcaaccaaagcaaaactggatcaaggggatcttttctcacttccttttgtgtgtgttttttagaatttttttttggttgctatggggattacatgtaacatactaaatttataacagtctagtttgaaatggtaccagtttaacttctgtagtatacaaaaactttattcctgtatagctccatttccttgataagttgtttttgtggcagattacatctttattcattgtgtgctaaatatcatagatttataattttttaatgcttttgtcttttaagtcatatagggaaaaaaggtggagctgaaaaacaaaaatagaataatactggctgtgatatttgtccatatggttacctttgctggggatctttattttttattttttggatcttcattttttcagatggccttaagtttctgtttagtgtcctttcatttcaacttgaagatgccttttaggatttgatgtagaacatatgtagtggtgatggactctgtctgcttttttttttttttttcttaatctgaaaatgcctcgatttcaatttctctttctttctcttttttttttttttttttttttttgagtcagagtcttgctctgtttcccgggctggagtgtagtggtgcaatcttggctcactgcagtgttgacctcctgggctcaagcaattttcttgcctcatcctcctgagtagctgggaccacaggtacatgtcaccatgcccagctaacttttatgtgttttgcagagacagagtttcgccatgttgcccaggctgatctcaaactcctgggctcaagcaatctccctaccttggcctcccagagtgttgggattacaggtgtgagccactgcacccagcctttattttttcctcatttttgaaggacagttatgctcaagatagaattccgtatgtcatcctactcacttctggactccacagttctgatgagatatgagctgttcgtctgattcaggatctcctgtatttgacaagttgcttttctcttgctgctttgaatattatttctttgccattggctttgacagtttggttatcatgtgtctccatatgaacctttttgaatttaacctgcttagaagtcacggagcttcttggatgtgtagatttgtatctgtcatcacatttgggaagttttggtatgttatttcttctttttttttttttttttttttttgagacagagtctcgttctgttacccaggctgaagtgcagggcaggatcttggctcgctgcaacctctgcctcttgggttcaagtcataactgtgcctcagcctcccgagtagctggaactacaggcatgcaccaccacgccagctgatttttgtatttttattagagacggggtttcaccatgttggccaggctggtctcaaactcctaacctcatgatctgcccgccttggcctctcaaagtgctgggattacaggcgtgagccatggtgcccggcctcttcacatgttcttactgcccccttctcttctagaattcccatattcatatattgtttcaccttcaccttttttttttttttttttttggtgacagagtgttgctctgtcacccagcctggagtgcagtggtgtgatttctgctcactgcaacctccacctcccaggttcacgcgattcctgtgcctcagcctcccaagtagctgggattacaggcacgtgccatcacgcccagctaatttttgtatttttagtagagatggggttttgccatgttggccaggctggtcttgaactcctgacctcaaatgatccacccacctcagcctcccaaagttctgggattacaggcatgagccaccgtgcctggctattttcagtgttttaatcttgatgctgcttagtgggtctgttcaatttgtgaaaattcattgagttctatgcttaggtatgtgtacttttctaaaatgagtaatgtacttcagtaaaagttaaaaatcctagcttaaaagttcaaatttcatatttaatttatatttcctttcctttgccaggttttgactcgaagagacttgcagtaagaaggggtgtgatcctctctttcttttctcctctcctctgttatctggtttctttactttggtgtcttgtgggaaggaatagggaaattgaaaagtgtatgtgtttctcttaattggtactgatcaaattctttcttgattgttctttctctggctaagacggattattcatccatacagtgtagcaggcatccaaatgctggttctcccatgcagctggttgtaagtttttttgagataggatctttccctctccacattgtcttcatagaggatatccactttagcttgatgtcttccaaggcctcctcagttctctctacctagagcttcttgctgtgcttgtcacctttgtgagtggccaaccctctttaatggattaccagcattagtccaaagtctgcttccttccctggtttctccttgatccataggtactgtttcatccttgacatgccaaatagtgcaaatacaagctgttcccttgctaccttctgtttttgcattaagttctatttcctgttccccgtctcactgctcagtcctgctacagttaggtgcctggacacatcaattgtttgattcagtgccacaatatcctcctttatccttttattcacttaccaccatgttttgaaattgtctttttcttcttttcaggtatttttcttcaccaacttcactcttctttttatgtttgggcatttgtaaatcatgttttggatagtcaccaccaaccaatattagtacttacccatttttttgaactcactaatcacaatatataactgtatagaatttttttcttttttttttttttaatcttagagaactggaaatttcctccttttttgccccttgtggcttttagtattgctatggtgccagttacttgaagcttgtttttcaaatggcaggtgacatggggtcagttattctcttttttttttttttttgagacggagtctcgctctgttgctcaggctggagtgcagtgacatgatcttggatcactgcaacctctgcctcctgggttcaagcaattctctgtctcagcctcccgagtaagccggggttacaggtgcctgccaccacgcctggctaatttttgtatttttagtagagacagggtttcatcatcttgaccaggctggtcttgaactcccgacctcatgatccacctgcctcagactcctaaagtgctgggattacaggtgtgagctactgtacccggcccagttattctctaatggttcttgtctctgtactgtctagatcagtttgatgtgttacttatctgtatttgttacagcttccttcattgacatataatagatatacctcatcgggctgatttttttcgaaagtttcttatttattataatactcctgattaggtgggtgttggcttaaaaatgtctacatgttgatgatattattggacactgcttactgaatgaggagaaagaggtgttggagtggaatgggaaggttctgtcaatgttttgtattgcctgtattttctgatagtacttttatactttgaaaacctgtatttagctcctcttataggcatataaagaaagctctaatattaattttagcattaattgaatgttagagatatttctgactttatatgccaggtaaagtctaccatttaatgattttttttaaactaaaatatgcttttctttattggatataggaagggtatgaataaaaggataaacataaataaacttaactaagaagtgtactcattatgaatactatatcctgtcaaaatgtctgtcatcccatgacctttctcacctatttttcctttggcattttaataatcaatatcctgtgtcctttacagcatacctagcttttactaagaaatatgtttctggttttagctatggagggggaagtataatattttggcacttttaaattgtagtgaatgctgtagagatgtttaatataaagtttttatacttcagaggagatattaaagactcatgttttactctttttctctttgaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaaatatctgattttgttgttttaagaaatgtgggaccatgtggtcaatatttaagtgtatattaattgaattggcatcttgacagtttcttctctggtagtagtcttgtatagaacatttatggtaaggctgtcttcctctccttacttcttcctcatggaatctctgattgctaacctgtaggacctgatagatatttcttggttgatcaccactagtggtcactctctcttactctgatttttgctctctgcctatttctgtaaactttatattctttgcttctgtagattttcttttttccttcattctcaaaacctaaaactcatagtggcctctaccgccttcaaagaaaagacttaaaaaattcagggggaaaaaattatacgaagaagtcacagtacaaaaggaagcaattacattgtacattgtggcataattcttttctttcctttttttttgagatggagtttcgctccgtagcccaggctggagtgcagtggtgtgatctcggctcactgcaagctccgcctcccggattcatgccattctcctgcctcagcctcccgagtagctgggactacaggcatccgccaccatgcctgtctaattttttgtatttttagtagagacggggtttcactgtgttagccaggatggtctcgatctcctgagcttgtgatccgcctgcctcagcctcccatagtgctgggattacaggcgtgagccaccgcgcccagcctcttatatttaaatttttatttttgctggtcatatatttagttacatagagccatttcttgtttggtttttcataacattctcctctttttttaaaaggatgcgattatcttctctttttttttttgagacagagtctcactttactgcccaggctggagtttagtggcatgatgtctgctcactgcaacctctacctcccaggttcaagtgattctcctgcttcagcctcctgagtagctgggatcacaggtgcgcaccaccatgcctggctaatttttttatttttggtagagacagggtttcaccatgttggccaggctgctcttgaactcctcacttcaggtgatccgcctgccttggcctcccaaagtgctgggattacatatgggaggtgagccaccacgcctgcctgggatgtgattatcttctgattgtcatgagtaaattagattttttatttaaaaatgtggctgggtgtggtggctcacgcccgtaatcacagcactttgggagaccaaggcaggcagatcacctgaggtcaggagttcaagaccagcctggccaacatggcaaaaccccgtctctactaaaaatacaaagattagccgggcatggtgatatgtgtctgtgatcccagccactccggaggctgaggcacaagaatcgcttgaacctgggaggtggaggctgagtgagcatcattacactccagctggggcgacagagcgaaactctgtctccaaaacaaagccaaacaaaaaaaaagtaaagttttcttacctggatcagctctttcttttgagcatctaacaaccagaatattcagtgttttgttctaaaatgctaaatcccttttatcctgtgaggtaattgcatggctgccgggtacattgttgaaatgtggttgtgtttgactgttctttctatggaattttccatttatctgattgcagctcgtgtcttactttatgacttttggggtgcttttcatttctgagtgcttagtctaagagtttgcagggcagatgatacctcacttttttttgagacagggtctcctctgtcgcccaggctggagtgcagtggtgtgatctcagctcactgcaacctctgccttctgggctcaagtgatcctcccacctcagtctcttaagtaggtaggactacaggtgtgcaccaccacacccagctaatttttgtatttttagtagagagggggtttcgccatgttgcccaggctagtcttgaactcctgagctcaagcagtccttccttggcctcccaaagagctgggattatagacctgagcaaccaggccaggccagatactccacttaattgcaatcccctccatgcttactatagcttatacctttctttgcccagttgcattggttacagtccatctatctgctttagatttccccacagttttttcaccccctcattatcagtgtctggctgtttctgtcattatggcctttgtttgcttactttttatttttatttatttatttatttttgacggagtcttactctgtcaccaggctggaatgcagtggcgcgatctcggctcactgaaacctccgccttcctggttcaagcgattctcctgcctcagcctcccaagtagctgggactacaggtgccatgccaccacacccagctaatttttgtatttttagtagagacggggtttcactatgttggccagaatggtctcaatctcttgacctcgtgatccgcctgcctcggcctcccaaagtgctggaattacaggcgggagccaccacgctctgcccaggttacttcttttgtctcatttttatggtgtttcctggaggacaaaagataaaagcatgtgcttggtctgccatctttaactgagaatgttttatgcattagcctcttgaattattataagaatagtaattagaatttttaagaggttttctttttttctgtgttatttatttactaaagagctgcttgttattctgtttgtttatgttgttccttccgttttatttattttcctcaagttcttggcagtctgcggtatgcttcagtctttactggtgtacagagtcaaataggtttcttctacagtgtgtaagcctctttcccaacaggcctttattttgaagagagagatgatagtaatctttgtgtaaataggataagttaagctgacttccctttagaattaataggtgagaagtaggcaggtcatctggagaaatgcacatttgcagaatgaaggaaagaaggcaggcaggctctactctgggcttatggaagttttgagcagaacaccatcatcatcatcattattttttttttatggagggctttatggaaagactttccagtaaaaggtacatttgagacttgaaaacttaactagattttaaaagtatattgtaattttctagtaaaacatgctagttataaaaaatgtcactacaaaaacatgcattatgtcaaagtgaagtctttcctttttttaaattttttgagacagcttctcattctgtttcccaggctaaagtgcagtgacatgaccatgcctcactgaagccttgaccacctgagctcaggtgatcctccccgcttctcctcagcctcctgagtagctgggaccacaggcacacaccaccatgcctggctaattttttttttttcttggagatgaggtcttgctatgtagcggaggctggtcttgaactcctgggctcaagtgatcctcctgcttcggcctcccaaaatgctgggattacatgtgtgagccacaacacctgtcctgaagtctttcttaatttttactttcttctatgtcttaattttcttctgtggttagctttgctaaattgttctccaaatgaattgtatcatattttgttggcagcaaaaacaaaaatatcccccaagccctttcttaacatctttactacattgggtattttcatgactaagattttaccaggcacagaaaggattttcaagtgagttgagtgatcatgataaagccaggggaaagtgcagggcataatattgaagttgagtgagtgaataagtgtggaaaagagtcgaaggagatgagaccagaaagataatctggatttatggagggtctttttcatatgccaaaatgtctggcataatatcttcaaatagtaaggagccatcagaggcttttaaggaaggaaatgacatgaacacatttttgttggttagatcacaagcaaaagtgtgaagaatggtgggaagaaggggagaaatgagaccttcacctcatttataaagtcattgcaggtcgggcgtggtggctcatgcctgtaatcccagcactatgggaggccaaggcgggcacatcacctgaggtcaggagttggagacccgcctggctaacatggcaaaaccccatgtctactaaaaatacaaaacatgagccaggtgtggtggtgcatgcctgtagtcccagctactcaggaggctgaggcaggagaatcgcttgagcctgggaggcagaggttgcaatgagctgagatcacaccactgcactccagcctgggcgacagtgagtgacactctgtctcaaaaaaaaaaaagccaaaaaacaaaaatcattggaattccctatacttggtctttataagtgactctctttcattgagattaaggcagacagtaaacctgaactgagcacatggagtctagtgagagcagaataggttcattgtttgcctgctggaaacttgcatctctaatgttacattgaggtgatgagaaactatgtaggctagaagggattggaaaactcctagactgctagtttgggtgttagagtgggaggctggcatgtggtgaatattatagagaacataaaatagttaatccatttcagtgttccacttgccattatcatcaccaccaagacagtcacaatttttaatggatagttggaaattttaatagattctaaaatggatgtgaacaattttactttgtatcagtatggttttatccacttgatatcactgtatttgtattttttcatttgtttatcaataaataattacatgtatattttccaaaccttgtatttgaaggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctggtaagtgttcataaaggtggcattttgctctatgaaaaatccataattgtcatttgtcattgcaacatctattctttttcctttttaggatttggagaattcagtttcccaaaatgaagtatggaagagaatgaatttattattattttttttagagatagggtcttgctttgttgcccaggctgacttcgaactccttggctgtagtattcctattgcctcaaccttccaagtagcagggactacaggtacatgtcatggcatcaggctaagaatgaaatttttttttttctttttttttttgagttggatttttgctcttgtcacccaggctggagtgcaatgatgtgatctcacctgcctcctgggttcaagcaattctcctgcctcagccttctgagtagctgggattacaggtgtgcgccaccacccctggctaatttttttgtattactagtagagatggggtttcactgtgttggctaggctggtcttgaactcctgacctcaggtgatcctccctgctcggcctcccaaagtgctgggattacaggtgtgggccaccactcccggccttaagaatgaaattttaattgaatctttttttttttttttttttgagatggagtctcactttgttgcccaggctgtagtgcaatctcggctcactgcaacctctgtctcccaggttcaagtgattctcctgcctcagcctcccaagtagctgggattacaggcacttgccaccataccccgctagtttttgtgtttttagtagagatggggtttcaccacgttggccaggctggtcttgaactcctgacctcatgatccacccacctcagcctcccaaagtgttgggattacaggcttgagccactgtgcctggcccaattaagtctattttgattgccctctcatgctgtcagtgtcactggtactaattgtatagtgagggtcaaggaaaagattctgtaaggttgtaacttcaatgagtaaattttcctgggaaagaacattctttttatagaaatgattctaaatctggtacagttgtgctgctttggtttacagctctgtggtatacatatttagtacatgaggacagggaacttgtttggcacatcatgggtacttaaagtatatgtataagaatgagggccgggtgcagtggcttacgtctctaattcctgcactctgagagtctgaggcaggaggatcgcttgagcccaggagttcaagactagcctgggcaacatagttgagaccttgtctatacaaataataataatcataaaaaaaaaattagccgaggatggtggggtgtgcctgtagtcccagctactcagaaggctgaggtgggataatcgcttgagcctgagcagttgaagctgtagtgagttgtgattgtgccaccacactctggcgacagagtgagaccttgtctggaaaaaaaaaaaaaaaaaaagccttttgtttgtctaggctttgtgtgataggcagggccttacaaaattaaagctgtgtagcctgggcaggttgctttgtttctgcctgttgttacaaattatacccttttatcctcaaacttgcttttgtaccaaaggcacccactggctttctgctcatctcacactgttccctctatccttaggtctaggcacctactaatttgtagggtacaataacagaaacttgttactattaaagtctcatctacacttgaagatataagccttttgggtcaacatatgtggagtagaaagttttgtccatttgttcaatatgggaagtgggagtagcggggaggatgtctttgtgtagcaggtgggaggctaatttttggatcaaaggatatcctgataataccgaagtttgtgattctcaggccacagagagaatcaggatcatttgtgaaaattcctacctccttaattttttattttgaaattttgaaatctgcagaaaaatagacagaatggtacagtgaacacccatgtaagttttacctagactgactaatttgtacattttttccatatttgttttttctgtgtgtatatatgtatttttttcccgaagcatttcaaagcaagtcacagactaattacgatacctcatccttaagtatttctcctaaggtgaaggatactctcctaaataactacaatatatgaccagatctaagaagtttaatagtttttttttttttttttgagcctgagtctcgctctgtcacccaggctggagtgtagtggtgtgatcttggctcactgcaacctctgtctcctgggttcaaatgattctcctgtgtcagcctcccaagtagctgggattacaggtgcgtaccactacacctggctaatttttgtatttttagtagagatggggtttcaccatgttggccaggctgatctcgaactcctgacctcaagtgatccacctgcctcggcctctcaaagtgctgggattacaggcgtgagccaccgcacctggccacatcattttaatagtaacatctaataatgtgaagaccatattgagattttcctacttggtcccaacatgtctattaaagcctcgcctgcttcccttttaacctctggaacctaaaacaaacaaacaaacaagcaaaaatggatgagtgtaccctcctagagattttgatccagatgtctggggttagtcacaagcatctgtgttttcttttcttttctttctttctttttttttttttgagacaggttctccctctgttgtccagtctggagtgcagtgtcatgatcttagctcactgcaccctctgcttcctgggttcaagtaattctcatgcctcccgagtagctgggattacagatgtgtgccacctcacctggctattttttgtcttttcagtagtgatggggttttgccatgttggccaggctggtcttgaactgctgcctcaagtgatccaccggccttggcctccctaagtgctggggttacaggtgtgagccactgtgcctggcctgtattttctttaaagtgttaccctgattctaacaacgtacttctttgagaactactgccaccatgatacagctgaatattccactttaaggtggtatgttgcagaagggattcccggactgaggttactggaacctaggccaagtgagctagaatattcctgaattaagttttttttaaattaacagtttattgagatataattcacatatgatataattcacccacttaaagtatacaggtcagtattttttggtgtatttcacagacatgtacagccatcactgtagtcaatttaagaatattttctttactttagaaactgtactcttcaggtatcacctcctcattgttccatccctaaccccgcccccacactaggcaaccactaatctactttccacctctataggtttgcctattctgtatttttcatataaatcaaatcaaatatgtggccttttgtggcggctgctttcacttagtctaatgtcttcaagattcatccatgttgcagcatgtgttcctttttgttgccgaatagtattttgttgtatgtatatatcatgttttgtttagctgttcatcagttgattcatttccttcattcttcaccttcattttctaatgtttattgagaggatttatctgagggcttatttttcccatatatgtagaaatcatgatcctaattagtgattaccagggcatgttctaaaaaggatcatacaatcgtatcattatatgtgcctagggatggaggagaacttaggtggaatattgttcaagattagttcttcttcttcttaaaaaaaaattacatagagtgaaaatctgttgttaacagtgggttgtttctgccttttggctattataagtaatattgctatgaacattcatgtacaaattttaatgtagatatatgttttcattcctcgtggatatatatctaggagagaagttgctgagtcatatgataactgtatttaatcatttgaagaactttgatttctctacatccttgctatcctggtgggtgggaagtgatatcttgtgtctttgatatgcatttctctagtgactcatgatgttgagcatctttcatgtgcttaccggacatttgtttgtcttctttgaagaagtgtctatttggattattggccatttttaaaattgaatgtttcttttattgtaagtttgtaaaataattgtttctttagacctgaatccaatttcttctctttcccagggaactgctttttgttttctcttgtgctttttttttttcctgagctacttatttacctactgtaacttcaagctagctcttctcttcccattctcccgcctaaagattttcagttgaatattttatgttaggtggcacatttgctagttggtattaaatacctatttctgctttgaccacccatactggaataaacctcagtgtctaccctgcttctggctgtgacatttctgaaaaatcttaactagaatgtattctctttggagtaacggccgtctatagtacatggacccagcctccaaagaacttttgggttagcagaacaggattcacatataataggacaactatttaaaaataataaaacatcacatttaaataaatattgtattgatttttatttaaatagtaacaaaagggggcaagaattatactagttataattattggaatgataactggtaggaggttagacttgaccagagtctggagaatagataagcaaaagccttaaagttgcaaatatttccattttgaggccatctagatgatgtttttatgaagagatttttggactcttcattttctgatgtctattgagaggatttctcagaggacttattttccccatatatgtaggaaccatgatcctaattagtggttcccagggcatgttctaaaacagatcgtagaatcatattatttattatatgttcttagggatggagtaaaacttagatagcgtcttgttcaagattagttattatttgtattcttaaaatatatatacagttaaaatctgttgttaaaagtggcataggagaaagacccctgcattagaaatcagaagaccaagctctgatgctgctatgtgaatctgaataaacatactggagcctatgttcttctcatctgtaaaatgaggtcagttcctgctttgctttctcctgagtatgttaactagtatctgcagttttgatctttgccttctgtatctctgatgtaaatccacttggctgtatcaccattctaagactcaccctacctgtctactgtctttccatccgcccaagccagttcttccttgttcattccctgtctttttttttttccataattgaaattttattggtagtgttgaggatcagtacacagacatttccatttgtacacagttcttaacatatctactggaaatctaaaaagccatgtattgtatttgttttttaaacagttattccagtgactttccagcttaaaatttggaggcaaattttccttaggaggccatcaagtatcctaaggaaaataccagtattgtcaagtgttacatacatcctaccaatctaccagttcacaagttagtagtatatatactacatactcaaattttcaatctttcgcatcacattaacaaagttatcaggaaagtaagactactttgactacagatgttacagagtgcacacagttctgacagggagagccatgatcaaggagtgattttcgttagaaaacaattctactaaaaaacagtgtgagaatagaagtaatctaaaatgttcaagtcatgattaccaataaccattctaacatgatactgtgattatagcaaactgctataatcttaaactgaattgggaatatttctaaccagaacaaaagatgtgatattctgttgaacattttatcatcagttctcatgttgaatatgatgtcattttgggtgccatattattattgaattttgttgagatgagattttcagataacataaaattaaccattttaaagtgtacattttagtggcatttcatgcattcacaatgtgtgcagccatcacctttatcaagttttaagacatgttcaccaccatcccctgcaaaaaaaatcctctacccattaaacagtcattattcattccaccctcattctagctagggcaaccactaatctgctttttgtctctgtggatttacctattctaatatttcatataaatggaatcataaaatatgtgcccttttgtgcctggcttttttcacttagcccaatgctttcaagatttttctgcattatagcatgtatcaatactttattccttttttatggctgaataagattctgttgtatgggtaaaccacacttttatccgtttgtctgctgatagacatttgagttgtttccaccttttagccattgtgaatagtactgctgtatttgtgtacatgaatttgttttgaatacttgttttctgtattttgggtatgtacctaagagtagatttgttggatgatacagtaattctttgtttaactttttgaagaactaccacacttttggtttgctacaccattttatattcttcccagaaatatatgagggttccagtttcactgcatccttgccagtacttttctgtgtttttgattatagccatcatagtgggtgtcaagtggtgtcttattgtggctttgattagtattatattttaataatattttagaactgtctgttgaggtcacatggagtatgctgttaaaggaaataacaaaactccaagacttttcttagaacctagaaccttttctcatcattaaaaagattcttattttaatttatattattttagttgaaaagtaatcccatcattcttaatttatttttccttaattttcacgagttcaaagaggaaaaacccatagacgtttgttttacctacttcagtattataaagagattccaaattcagcacttcccctttcagtattacctttctgctgctgtagttttgcattttctactgtgaaaggtggagatatctatatctatatgtcagttggctttattgaggtataatttacatagaataaaattcacccgttttaagtgttcagtttgatgacttttggcagatgtatacagttgtgtcaccaccaccacaattatgatatagttatataagaattatggtatagaacagaacagcattccccaacctttttggcaccagggacgggtttcatggaagacagtttttccacagatgggtggaggggggatgggaggtggtttcaggatgaaactgttccacctcagatcatcaggcattagctagattctcatgaggagcgtgcaacctagatccctcgtatgcgcagttcacaatagggttcatgcccctacgagaatctaatgctgtgctgctgatctgacaggagacggagttcaggcggtaatgctcaccctcatacagctcatctcctgccatgtggcctggtccctaacaggccatggacctggtatagaatatataatgctcaccctcatacagctcatctcctgccatgtggcctggtccctaacaggccatggacctggtatagaatatatctgccaccccaagttcgcttgtgtccctttgctgtctgttctctctccccaggcccagcctttggcaactactgatgtgctttttgtcactgtggttttgccttttccagaatttcataggaatggaatcatacagtatatagtcttttgtgtcttttttcacttagcataatcctcctgagattcatccatgttgttttgagtatcaatagtttgttcctctttattgctgaaaagtgttccattggcatgggtatatagacttttccattccctagttaatgaccatatgggttgtttccagtttttgcctgttagagagagagctgctgtgaaagttcatataagtttttttgtttttgttttggtgtggaatatgctttatttctctcgggtaaatacctaggaatgaaactggtggaatgtatatttaccagtgtaaatttatctttataagaaactgccaacctgttttctaaagtggctataccatttttgcatttccaccagcagttgctccacatcttatcagtactaggtattatcatatatttttttttgagatggagtttcactcttgttgcccaggctaaagtgccgtggcacaatctcggctcattgcaacttccacctcccgggttcaagccattctcctccctcagcctctcaagtagctgaaattacaggcgcacgccaccacgcccagctgattttcgtatttttagtagaggtggggtttcgccgtgttggtcaagcttgtctcgaactcctgacctcaggggatccacccgcctcagcctcccaaagtgctgggattacaggtgtgagccaccgcacccggctatcattttttaaattttagccatactagtggatgtgtgggagtttctcattgtggttttaattttaatttgcatttctctaatgactaatgagattgaacatatttttatgtgcttatttgccaattatatatattcttttttttttttttttttttttgagatggagtctcggtctgttgcccacgctggagcgcagtggcatgatcttggctcactgcaacctccgcctcctgggttcaagcacttcttttgccttaccctcctgagtagctgggattacaggcatgcaccaccatgcctggctaattttctctgtatttttaatagagacggggttttgccatgttggccaggctcttcttgaactcctgacctcaggtgatccacccgcctaggctttccaaagtgctgggattacaggtgtcagccaatgcgcccagtcagctatttttatatatatacattctatgatcaaatgtctgttcaaaacttttgtctatttaaaaaaaaattttttttgtcttattgagtttcaggaatcttcgtatattctgaatacaagttatatatcaaatatatgccttctaaacatattctccctgtctgtgacttacattttcattttcttatcagttttacacaaatatttatatacgaaaaatgtggaaatcagttgtatccctctatactaacaatgagtaattagaaatcaaaacttaaaaatcaggactgtttgcaatagtttaaaatatgaactacttgaagataaattccagaaaccattttggaagaccagtacattgaaaactacaaaacattactgagacaaattaaagaagacctaaatgaatggagagatacaacatttttgtgtattggaagactcatatcttttcttttttttttcctttgagacagggtctcactctgtcatccaggctggagtataggggtgtgatcttggctcactgcgacctccgcctcctgggctccagtgatcctcccatgtcagcctcccaagtggctgggactacaggcaccatcacaaatttttttttttttttttgagacggagtctcgctctgtttgccaggctagagtgcaatggcatggtctcagctcactgcgacctccgcctcccgggttcaagtgattctgctgcctcagcctccccagtagctgggattacaggtgcctgccaccatgcctggctagtttttggtatttttagtagggatggggtttcaccatgttggccaggctggtctcaaactcctgacctcgtgatctgcccgcctcagcctcccaaagtgctgagatcacaggcgtgagccaccacgcccagcaacatctggctgatttttgtattttttgtagagatggggtttcgccatgttgcccaggctggtcttggactcctgtactcaagcaatcctcctgccctggcctcccgaaatgctggcttacaggcatgaaccacctggtgcccagtctaggaagactcatatcatgaagatgtaaattttctccattaagctatagatttaatgcagtcccgatcaaaacccaggtagtatttttcagaaaatatcaagctgatttcaaatgtgtattgaaatgtaaaggacctagaataaccaaaacaatattaaaaagaagaccaaagttagaggaatcaaacttattttatgactttgtataaaggaacagtaatcgggtcagtgtgattattggtataaggatagatatatagatcactggaaccaaatagacaaatttgccaaggcaatttaatgggggaaaaggtagtcttcataacaaatggtgttgaaacaattcacacaaaaatatcaacctctatacttacctcatgctgtacaaaaattaacttgaagtgggtaattgaacaaatgtaagagcttaaatcataaaatgtgtagaggaaaacgagaaaatttttgtgattttaggtggggcaaaggtttcttggagtaaaaaaagcttaacctataaaaggaaaaaaattggcttttatcagaaagaaaaatttttgctcttcagtatttatttttaatggaatgaagacaaattgaagtgtatctacaagggggtggaatgatgagtaaaacttgtgttaaagagttattaacagattttgttgtctgtttggattttaatacatatcactaccttctacctttggaggtagaaatctagaagtcataatgaatgttctttgcatgcaactcctgtgggtttacccgttaatttatacttttttcatttctactcaagaaaatatatttgaatgaaatcattgtgaatgccttctactttacaaaagtaaatacaaactcaggctgtacacctgtgttccacatcctactcctgccacttagtaatcatatgaccctctacaagtcactgaacctctttaagcctctgttttctcatctttaaaatcaaaataatattaagacttcgctcatgcagtttttaggatgaaatgagacaatccatttaaaatagcatagtgccagatttatagttaaatttagaggcagccaaaagctacctccctacatagtgaactataacctaatttaatatataaactacctgcaacctaacctaagagtatactcttgtaacaagtagctgagcctcagtcaagcatagcagccaagttttcagccagtcatataggctgaatattgccaaagcatgttcaaataaggcaaacacctgaactgcagcccatcaggctacttctgtatgtcatttctgtttctctggctataaatatagcctacatgcattgggggatggaacattctgaactgcatttggtactggatgctaactggttcattaatctctatttttttgagacagggacttgcttagtcacccagggtggagtgcagtgacatggctcactgcagtctggacctcttgggcttgagtgatgcttctgcctcaggctgctcccttccccacctttcccggaagctgggaccacagttttcatttccttattatttgtaatgggggttgggggtgggggctccctgtgctgcccaggctggtctcaaacttctgggctcaaccaatcctccagtctccacctctgcctcccagagtgctggaattacaggggtgagccaccgcacctggcaaatctgttttttgttcaattaagtcattaaatttaacttgtctcaggtttgtcatttaacaatatgaacaaaatgtatatatttttttctttttatgcctcggtacttcaaatagttattagtagctgtgatacagtaagaaatattgtgtatatttcttaccgtataaagaaatatatacatatatatatttcttctgtatatatatataattactgtgatacagtaagaaatacatgtattccttatatatgtagctgggaccacaggtggatgccaccatgcctggctaattttttgacttttttgtagagacaggatttcgccatgttgtgcgggctagtctctgctgggcaaggtgtcagaacccggcagtggagagtggttggctcactggtggtaaaagaatttactgacagcagtataggtttagaaaggaaagttttattagatagaatgctgcagcagagtgcagtacagtgcttcattcagcaaaaaggactgagtgtgttgcggtggattttccttaggggtatttatggactttaaagcaggaccttagggtaatttggaccatattagttatgtaggtcatggtaaattattacatttgtagactttgggtgccttgatgttagcaagggttgcaaaataagttttgacattcatgcattctggagatgtatagaaattctagttacttataaatttttgggaaagaagcctggtaccagatgctggctttagataatagagaagtctaattacttttcaatttttcagataaggagttttgtcttcggatggtctgcttgattgccactaggtgatcgttgtattcttctgtgtcgaactcccaggctcaagtgatccacccgctttggcctccctaagtactgggattataggaatgagccactgtacctggctgttacttttatctgaaattgagaatacaggaaaaggaacaggtttgggggagaaaattaatgagtttgattctcagatgatgacaggtaatctggtgtacatatccttttaaaaatattgatatgaaatttacataacaaaatcaaccattttaaagtgaacaattcagtggcatttagtactggcagatttgtttttcacaatacaactgccacctctatctagctgcaaaacctgcctgttactttagatttaaacctcttatccattaagccctttctccccactccccttccatgcaatctgcattttgtctctatggatttctctattctggatattttatataaataatattatacatatgtgaccttctgtatctggtttatttcatttagcataatgtttggatgttcatccacattctagcatatattggtactttattccttcttttggttgaataatatctcgttgtatgtgtccaacacaactttttatccattgatggacactgggctgtttccaccttttggatactgtgaatagtgctgctatgaactatatgtatacatgtacttgagtacctgtcttcagttcttttggggatatacctggggtggaatcacaaagaaatacggtaattcaactttttgaggaataaccaaactgttttctgtaatagcttaccattttacagttccactagcaatgtactgaaggtttcagtttctctatatctttgtcaacttgttatattccatttaaaaaattattgtttagttatactatcctggtgagtatgaagtggtacctcattgtggttttgatttgtagttctgtaatgactaatgatgttgagcatcttttcatgtgttttttgaccatttatatatcttctttggaaaaatgtctatacaagtcctttgcccattttttttaattgaatttttttgttgttttaagtttgttatatattctgggtattagacccttagttatatgatttccaaatttttttcctgttctgtgtgttgtctttttagtttgttggtaatgtcctttgaagtttaaaaatgcccttgatgaagtctaacttatctgtgtttttctgttattgcttatgcttttggtttcatatctaagaatccattgccagctccaaggtcatgatttacttctgtgttttcttctatgaattttatggttttacttcttatatttacttcatcgacccattttgagtcagtttttatattcagtgtgaggcaagagtttatttttttgcatgtggatatcactttttaggtatcctttcaagagttagatgtccagagtaaagtacagcagtttagggctatagatgtggacttggaagctgtggattaaatcaccatgggagagagtaaagagaaataaaaggaatgtaggggaacatgaaaaaattacatgtgaaaggatagataatgttagacagtgaagtattcaacttagataagaactgtaggagtttagataaagtgcattcacttgagaattgctgtccttttcactcttagtttttctttttgtaagaggaacttgtttctaatgccatctagtgtcttttgaagggtatatgagtaatgttaagaggttttaaaataaaagttttgaaatttcatgagacttgagcagtatattggcagtcttagcttactctcaagagcatccttaagagagaagtaaaagaacacattaaatactttgcctgaacaaattcggagctgaatttcatcttgaatagttaagcatttttatcatctcttttgtgttaatttgtaaagaatttaagataccttaaaaatagtgacgtcaaatttttttcttatcttgaatttgtcttacaaaaattatagacagccttacttttttttgtttttgtttttgagacaggatcttgctctgtcacccaggctggagtgcagtggtgcaaccttggctcaccgcagtgtcaacctgctagggtcaagtgattctcctgcctcagcctcctgagtagttgggactacaggcatgggccacgatgcctggctaatttttatttttatttatttttaaacttttatttatttattttttgagacagagtttcactcttgctgcccaggctggagtgcagtgactcactgcaacctccgactcccaggttcaagtgattctcctgcttcagtttcctgagtagctgggattacaggcgcctgccaccatgcccagctaattttttgtatttttagtagagatggtgtttcaccatgttggccaggctggtcccaaactcctggcctcaagtgatccacctgcctcggcttcccaaagtgctgagattataggtgtgagccaccgcggccagcttaatttttatttttaaactttttgtagaggtgggattttacagtgtttcccagtttggtctcgaacccctgggctcaagcaatcctgcctcagacttcaaactatcgggattacagttgtgagccactgcacctgccaagcatctaaatttttaaaaggcatttaaaataaaaaatttttttagataaatttgttggttgattggtttgttcgtccgttttgtgctgctatgacagaatactcgaaactgggtaatttataaggaatcaaggtttatttcttagagttcttggggctcagaagcccaagatcaaggtaccagcatctgatgagggctttcttggtgtttcctcacgtggcagaaggtggaagggcaatagagaagaaatccattcctgtaagccctttttatagtgacattaatccattcatgagaacagagctttcatgacttaaacacctctcaaaaggccaaatctcccaccactgttgcattggaaattaaatttccagcacatggattttggggaacacattcataccatagcagttgaggttacagaaagagatcttactgaatttgttgatggttagaatacatgggagaacgtttatgcaagtttttggtaaggtgtcatatatgtcaaggagaacggcattattaaaccactagtaaaaagttataagagcaggttttgtttttactcttatacaaaaaatatcagtgctagtctttttgtttttttcctttttcttttttgaaattgcagaaataaattttatttttaattttcagaggttaaaaaaagttatgatactttaaactgttaacaagacttagttgatatccagttaacctaatacagcattaatgtttttattattttcttgaagagactcaaatacacctgcattgtgctcttttaaaaacatattaaggatacttgtatttaacaagttttttaggaaaaacattgtacaacatttatgtttttcatgatgctgaaaatgctgaattacatgtcaatttaatttatctcttagaagaaaaagtaacataattaaaatcactgggtctctaatctttagttctctctccacaaataaaacctgtcacttttcacaataaaaaagcaaaaaataatatacaattaaaaggagctaaactgaaattctttatcctctttttccttttttgagacggagtgtctctgtcgcccaggctggagtgcagcggtgcgatctcggctcactgcaagctctgcctcctgggttcacgccattttcccacctcagcctcctgagtagctgggactacaggtgcccaccaccatgcccggctagttttttgcatttttagtagagacggggtttcactgtgttagccagggtggtctcgaactcctgaccttgtgatctgcccgcctcggcctcccaaagtgctgggattacaggcatgagccactgtgcctggcctctttatcccgtttcaaaagataaattaattgtgggagatcaacataacaatcatcactgattttttttttaaccatttaactctggttcaaaagataaataataatctataatccaccagtgtatacaaattttttatcacattttcccttatgttgtaaaaaaaaagaaaataggtttaatgtttaaagaaggattaatttgatattattactgaaagacaattttgctgttatcacagctcaaaaagtagtgacaggaatcttttaggaaacaggttactgtccgtttcacaaaatgtgaaattagatgatcataaatatacaagaaaatcaaaacattttctgtccttagttatattgctccccccggcctgaaatttagatgaaaaagattaaacaacttttgcagatcacgtctatctattttagcaacttaatataaatgaaaagcaatcttcattttaaaataaatatcataggccaggtgcggtggctcatacctgtaatcccagcactttgggagtccgaggcaggtgaatcacgaggtcagaagttcaagaccagcctggccaacatggtgaaacccagtctctactaaaaaaacacaaaacaaattagctgggcgtggtggcgggtacctgtaatcctagctacctgggaggctgaggcaggagaattgcttgaacctgggaggcagaggttgcagtgagccgagatgatgccactgcactccagcccaggtgacagtgcaagactccgtcttaaaaaaaaaaaaaaattaataacaccatttttgaaactgcaaatgaaactctcatcatataagagaatgtcaacatcaaattcttgtatcttgatgattatgtaccataatcaatgaatataatttgaagctctcaaattatttattttgaattcaagtgaagatgattaggctaatccagtcatttcctcttctgagtcatttgattcatcgtttagttccaattccactaaatcttggtctgtagttataatagttttcctcttgcacttcttgggaattgcatcattagcacagatttttctcattttaatatttggcaatttcttcagatcaaagtcccattccctaaatgttttcagattacttgcatttagaatgtctggaatctcaaagccacatcctttatactgctgtccctcccgctccatcgtctgcttgatgatggtgtcctgggaacagtgctgcctgtcctgcttgtccctgatactgttatgtaactcaatctgctccaactcactgctaaatcaatttaatttaagtacctttcagttagttcacaagcatctttgtttgaatatctttttttgggggggatcaagatgattttgaaaccattgcagtttttcaccaataagattgaaacacaaggccttttcattcttcaatttttcctttttttcttatttgtgggcctctctcataatttgagctgcttttctactatatggatgaatgactttttttcccatcctgcactttttccctttggtgctttaggtatagtgacgtcctcgcggccacagaggagctctgcactctagacccaggcagtctcaccaaccacaagagcagcagctcacaggagtacccgtgccaaatccccctggggcctccctttttctttttttttaagatgagattttgccatattgcccagtctggtctcgaactcctgggttcaagccatctccccgcctcagcttcccaaagggtgtgagccactatgcccggccagtactagtcttttaattaggctgttattgtcatgtgttgcttcgcactggtatatttacagtgctgagcaaagattgaaaagcagtgctactggtgcattctatcatatagacaatataattactagtgatagtttagttgcaatagagaactaatatttactagaccctattcctagtttaacgtatgttctcctttattttctccagaacattgagttgtcattcttcatttttgcaatatgtcttatctatagaatgtatagggaacaaggctggtttcagcatgtgtagactggtggccttaagagatagcaatgttaagaaatagtagtagtgtacaataaaccattaatatagcagtcctgagactactatccttagaaaggcttgtgcggaaggccgacccttggctggtatctggaaacttgaatggtaaacagtttcctacactgataaaaatttccttgaatgataagagtgacttactgtgcaaacaatgtgatttatgctgaacatttacttaccttctgggagtctgaaattttggtatgtagtaggcaagagggtgcctgtgtgagcagctccattaaaaactttggacactgagtctttggtgagctttcctggtagacaacatttcatggatatagttactaggtgttgctggaagaaataagtgtgtcttatgtgacttcactgggagcgaactctgggaagcttgtgcttggtttcctccagactttgcctcatgcaccttttccatatgctgattatatgcagggtcctgtgagtactcctggaggatcatggaacctggggatggttttggtgacccctgacacaggtagtctttgaaggatttatgaaaatagttaagggtatagccggagtaatcaggcaagagaaagaaataaacggcattcaagtaggaagagagaagtcagattatccctgtttgtagatgacatgattgtatgtgtagaaaaccccatcatcttggcccaaaagctccttcaactgataaacaaattcagcaaagtttcaggacaccaaattaacatacaaaaaaccactagcattcctatccaccaacaacagcccagctgggagccaaatcaggaaggcaatcccattcacaattaccacaaaaagaatacaatacctaggaatactgctaaccagggaggtgcaagatttctacaatgagaattagaagacactgctcaaggaaatcagagaagacaaaaacaaatgaaaaaacacaccatgctcatggataggaagactcaatatcattaaaatgaccatactgcctaaagcagtttacagattcaatgctattcctatcaaactaccaagaacattcttcacagaactagaaaaaacgattttaaaattcgtatggaaccaaaaaagagcttgaatagccaaggcagtcctaagcaaagagaacaaaactgggggcctcacgttacccaacttcaaactgtactatagggatacagtaaccaaaacagcatgttactggtacaaaaggcacatagatcaatggaactttatttccggcagaaataaagctgcacacctatgaccatgtgatctgtgacaaaactgacaaaaacaagtaatgatactgggataactggctagccatatgcagaagattaaagctggaccccctcttttcttttttttttttttgagatggagtctctctctgtcacccaggctggagtgcagtggcgcgatctaggctcactgcaagctccacctcccaggttcacaccattctcctgcctcagcctctggagtagctgggactacaggcgcccgccaccacacccagctaattttttgtatttttagtagagatggggtttcaccatattagccaggatggtctggatctcctgacgtcgtgatctgcctgcctcagcctcccaaagtgctgggattacaggcgtgagccactgtgccccgcccatattttctttatctagtccactgttgatgggcacctaggttgatcccatgtctttactattgtgaatagtgctgtgattaacatgtgagtacatgtgtctttttggtagaatgatttgttttcttttgtatatttacccagtaataggattgctgggttgaatggtagttcagttttaggctctttgagaagtctcccaactactttccagagtgctaaactaatttacattcctaccaacagtgtatacgtgttcccttttatctgcagtcttgccggcatctgttgtttttttgctttttgataatagctattctgactggcataagatggtatctcattgtggttttgatgtgcatttctcaaatggttagtatgtggagcatgttttcatgtttgttggctgcctgtatatcttcttttgagaagtgtctgttcatgtcttttgcccattttgtgatggggttgttttttgcttgtttaattgtttaagttctttatagagtctagatattagacctttgtcagatgcatagtttgcaaatattttctcccattctgtaggctgttaactctactgattgtttcttttgctgtgcagaaactctttagtctaattaggtcccacttgacaatttttgtttttgttgcaattgcttttgaggactcagtcataaattgtttcccaaggtcagtgtctggaatggtgtttcctagtttgtttgtttgttttttccctaggattcttacagtttgaggtcttacatttaaatctttaatccatcttgagttaatttttgtatgtggtgaaaggtagggttccagtttcattcttctgcatgtgcctagccagctatcccagcactatttattgaatagagtcctctccccattgcttatttttgttgactttgctaaagatcagaagattgtaggtgtgtggctttatttctgggttctctattctgttctataggtctatgtgtctgcttttgtaccagtactatgcttttttttttttttttttttaaacactgtagccttatagtatagtctgaagctgggtaatgtaatccctgcagctttgttctttttgcttaggattgttttggctatttgagctcttttttggtttcatgtaaattttagaatagttctttctagttctgtgaaaaatgacattggtagtttgataagaattatgctgaatctgtagattgatttggacagtatggctgtttcaacagtattgattcttctaatccatgagcatgaaatttttttccttttgtttgtgtcacctgtgatttcttttagcagtgtttgtagttctccttgttgagatcttttacctccttggttagatgtattcttaggtactttttctttttcttttttttgtagctattgtaaatgggactgcattctttacttggctctcagcttgaatgttactggtatatagaattgctactgatttttgtacattgcttttgtatcttaaaactgggaagccatttatcagttccaggagcctttggcggagtctttagggttttccaggtataaaatcatattgtctgcaaagaaagatagctggacttctttgctgtttggatgccttttctttctttcctttgtgtgattgctgtggctagaacttccagtgctctgttgaccagcagtcaggagagtagacatccttgtcttgttccagttctcaagaggaatgtttccagtttttctcattcagcatgatgttggctgtggatttgtcataggtggcttttatttattttgagatatgttccttggatgcctagtttgttgagggtttttatcatgaagggatggtggattttattgaaagctttttctacatctattcatctgacttccttttttctgcttgacctaatagaaaaaattttcagccctacttgaaatgaattacctgagctgagggactgagattgctgctggcaaatagaattaatggactattttttaaagagggcaaaaagctccaaacagaaacgtttctgagatgtgttggggcattttgggaataaagtaacatgcatttatagggagatactaaaatgaaaatataggaatttccttttttttcagttatttagcctttaaaaaaatacttatggttgcataggaagttgcaaaaatagtgcagagtactatgaacccttcacccagctttcaccaatagtgtcatcttatatagctataatacaatattaaaaccatgaaaatgacatttgtacaatatcattaactagattatagcccttatttggtctttatatacacttgtatatgtttgtgtgtgtatgtacaagtcatgcaatctcatcccatgaatagatttgtgtaatggccaccaccacaatcaacatacagaaccgtactgtcattacaaaggaattcgcttgggctgcccttttatatttgcactcccaccccgtctttatcttcttgcaaccactaatgtgttcttctctatgtgaattatatttatatttatatttccttttgatacagggtctcactctgtcccccaggctggagtgtggttttgcagtcatggctcactgcagcctccatctcccagtctcaggtgatcctcctgcctcagccttccgagtagctgggatcacaggcacaagccaccatgcctggctaattttttttttttttttttaatttgtagagatggagtcttgctatgttgcccagactggtctcgaactcctgggctcaagtgatcctcctccctcagccttccaaagtgttggaattaaaagggtgagccactatgcctggcctttatgtgaatattatataaatggaaccatatagtatataaccttttgagatttttttcagtaagtataatgtttttgagatccgtctaaattgttgcatgtatccactcagttctttccctctttgtgtgtagtattccattgtatggtcacacatcacttggttatttactcacatgttgatagattttatgtgtttgttttttgaatctgcaccactggcaatggatttttttaaagctattaactttttttttaaattaaaaacaattattttttgttgagatggtatctctgtcacccaggctggagtgcagtggcatgatcttgggtcactgcaacctctgtctcccaggttaaagtgattctcatacctcatcctcccgagtagctgggattacagtcgcctaccaccatgctcactaatttttgtatttttagtagagacagggtttcaccatgttggtcaggctggtctcgaactcctgagctcaggtgatccacctgccttggcctcccaaagtgctgggattacagatatgagccccatgccctaaaactataaacttttaaaagttttgtatgtattctaaatataaattccttgttggatatgtggtttgcaaataacttttttattctttttaacagagtgttttgcataacacatttattaattttttaaaaataattattgtttttttttgagtcagagtctctgtcacctaggccatagtgcagtggctcgatctcggctcacggcaacctctacctcctgggttcaagtgattctcctgcccagcctcctgagtagttgggattacaggtgtgtaccatcacgcctgtgtaatttttgtatttttagtagagacaggtttttaccatgttgaccaggctggtgttgaactcctgacctcaagtgatccacccaccccggcctcccaaagtggtgggattacaggcgtgagccactgtgcccatcctaaaattgtttttctgtttcttaaaagaaaaattttttatactacctttatgtgtacaatctcttttttttttcaatcagctttcttaggttgaaaaatgtctttaattttgatgaagttctgattgtgttcttggtgtcatgtctaagaacttttcacctattcctaggttctgaagattttctcctctgtgttcttttaaaaatttacagttttattttttacatttaactcatgatcaattttgaagtaatttttgtgtatagtgtgagttgtaggttaagcttatttttttattcagctcatggatgtccagttgttctagtataagttattgaaaagtgtgtcctttctgcattgaattgcttttccacttttgccaaaaatcagttggacatattcaggccgggcacagtggctcatgcctgtaatctcagcactttgggaggctaaggtgggcagatcacctgaggtcaggagttcgagaccagcctggccaacatggcaaaaccctatctactaaaaatataacaattagccaggagtgatggttcatgcctgtaatctcatctactcgggaggctgaggcaggagaatcacttgaacccgggaggcagaggttgcagtgagctgagatcgtaccactgtactgcagcctgggtgacagagtgaccctctgtctcaaaaaaaaaaaaaaaaaattggacatatttgtgtggtttatttctgggttctcttttctgttcagttcacttatgggactctccttctgccattaccacaatgttttgattactgctgctatatagtaagtcttaacattgggtagagtgattccttacacttactgttctatttcaaaatggttttagtgattttttttctttctacataaattttagaataagcttttttatatctacaaaaagtcttgctgggattttgataggaattacattaaacctataaagaaatatgagataaaggaaaaactaaacttttacctactctcaaactcaccacaacacaggacccttctgacaccacatttatgggttttttttccctgtacaccaaacagcagacagaagctgggtgccttataatttaactcaactcctatactgcatgcctggaataagcatcagatcccataggctaaggccctgtcccataagattgcccctactttagatccagtttcagtcctagctggttttacctgttcttttgactgaccagctataaattggatacagatgaaccaccaggtggagaagcacataggatgaggcaggtgggaaggagtgtggagcttcacccgctctgggctcactatcctccaggtacctgcatgtggtcaggatcctggaagctctctgaaccctgtacttcactgattttcatggcagctttatcacataggcatgatccccttcccagaggattggagggtgaggtggaaagttccaattttctaatcatggcttggtctttctggtgcacagcctccatacaggagcccagttaacattccctttgttagaacagaaggcatgtctatcacccaataaattctaatggattgggagctctgtgtcaagaactaggatgaagaccaaaaaatatatatttttattataaatcacgatatcacaataagttttgaggagaaatggctttttttttctatttgattcttctgacccatgaaaatagtgtgtctctgcatttatgtagatttttaattcttttcatcagcatgttgtaatttttagcatacatatcttgtatgtgttttgctgcatttctgtctctaagtattttatctttttgtattttcatgctgcttgccaggaacagtctcagtccctcagcgctggtaatttatttcaagtggggttgaaatttaagaggtcagatagaaaaaagaaatgagatgaaacttttttttttgcaactttaaatgatgttgtattttaaattttagtttttacatgtttgttgctactagtatatagaaatatggttggttttcgtgtgccgatcttgtatccggtgagtttgctgaactcatttaggagtttttcttgtagattgagcatttctacataggcaatcatgtcattttcaaataggacagttttattttttccaatctatatattccttttctatcattttctttctttattgctctggctaggatttaattaaacactgaatttttattctggtagtgctgacttcaggagcctaatttgggactagcaaatgctagttttactcaccttatcattacagtttcagatcttcggcttctcttgggcttcagaagtttaacttggattgatcttgaatattgatcttgaatatgctgaaggcaggaaaagctctgtcctgagtgtatacacagtgcaatataatttttatttatttgcctcccttgagtgtgagcttcttgaagaagacagttctgaagatacagggcttggtacacagcaaacttgtaattaatgtttgaggtcaggcatgggtggctcacatccgtaatccaatgctttgggaggctgaggtggggggattgcttgaggccaggagttcaagaccagcctgggcaacctagcaatatcccgtatctaaaaataataacagttacaattgtttgttgagcaaatatttaaatgaataaatggaactaatatgtggcttcttctcatataagaagtctagggaaaaccttttcagacaaggtatagtgtaactcaggttgaaatgacaaatgtgagactatttgcagtcacacacgcagttgcacatgtgattttgacatcaaacatttttgtttatttttgtttacttgcatgccttgtaagtttcatgttttactaacaagacactttattctttgagtgttacatgtcgtttggtttggcttgcttctgtatgttaaaaaaacgttctgtcttttgaaaagataccattatctaattggttttaagttaggagaattctaaattacagggcacagtaaaataaatgagcaattataccgaggaagagcaaaacaaacaaaaaagaatcatggaaccatgttttgtatatacgtggggagaagttatcctttagatctgttttttttttttatgtgagtatgcttgaatgtatatgtcatgagggtagtgggctgggctgagctggggaggagatgtgcatcatatgtagggagtagacttaagctagttatttttaaataatactttagcaagggaattagtacttgtttaagtgttcatattgccttaatattagcatagctttttcatcaatatgttcagtatctcaaacgtcaaatttgcatgaaaatattctcccaaacccctaatccttccctgttttatttttcttcattgcatttattatcttctaacatactgtatattttatgtattcattttttgtttaatgcctgtctacatccacttgaatgtaagctttaagaggtcagggatttttatctatttctattaacagttgtatagctaggcccatgatatcatctggtacatagagaatacttaatttgtaaatcaatgaaaggaagactactttgaaaagagtgatttctaggatattggaatgaggaatcttaatcataagcctatgtaaatgataaaatattatccctatggaatagcaggaaagtcattgtccttttaccctgaggagcatatttgtcctctataaaaaggcctttctatttggaaggaattttacttgattgattgactctctgtttaagcaacaaatgaaaaagaatcctttgttgagaagctaccacagactgtaaagtttccaggttctgtactttgtgctggatggggcaccactgtgatgggcctgatgagtctctgagactgctgcaggacttggattttgtaactaaagttagttcttatttttatactttaagttctagggtacatgtgcacaatgtgcaggtttgttacatatgtatacatgtgccatgttggtgtgctgcacccattaacttgtcatttacattaggtatatctcctaatgctatccctctcccctcccccgactccatgacaggccccagtgtgtgatgttccccttcctgtgtccaagtgttctcattgttcatttcctacctatgagtgagaacatgcggtgtttttttttttttttttttttttgtccttgcgatagtttgctaaggatgatggtttccagcttcatccatgtccctacaaaggacatgaacatatccttttttatggctgcatagtattccatggtgtatatgtgccacgttttcttaattcagtctatcattgatggacatttgggttggttccaagtctttgctattgtgaatagtgccgcaataaacatacgtgtgtatgtgtctttatagcagcatgatttataatcctttgggtatatacccagtaatgggattactgggtcaaatggtatttctagttctgcatccttgaggaattgccacactgtcttccacaatggttgaactagtttacagtcccaccaacagtgtaaaagtgttcctatttctccatatcctctccagcacctgttgtttcctgactttttaatgattgccattctaactgaaatgagatggtatctcattgtggttttgatttgcatttctctgatggccagtgatgatgagcattttttcatgtgtctgttggctgcataaatgtcttcttttgagaagtgtctgttcatatcctttgcccactttgtgatggggttgtttgtttttttcttgtaaatttgtttgagttctttgtagattctggatattagcccttcgtcagatgagtagattgcaaaaattttcccccattctgtaggttgcctgttcactctgatggtagtttcttttgctgtgcagaagctctttagtttaataagatcccatttgtcaattttgggttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgtttttgtcatgtttgtcaaagatcagatggttgtagatgtgtggtattatttctgagggctctgttctgttccattggtctatatctctgttttggtaccagtaccatgctgttttggttactgtagccttgtagtatagtttgaagtcaggtagcataatgcctccagctttgttcttttggcttaggattgtcttggcaatgcgggcccttttttggttccatatgaactttaaggtagttttttccaattctgtgaagaaagtcattggtatctcggctcactgcaacctccgcctcctgggttcaagtgattcagctgtctcagcctgatgagtagctgggactacaggcacaaaaagtgccatcacacccagctaattgttgtatttttaatagagatgtggtttcaccatgttggccaggctagtctcaaactcctggcctcaagtgatccgccagcctttgcttcccaaagtgctgggattacaggcatgagccaccacgcctggcccttgagctgggttttgaagaatgaataggagtttactaggtaagagctgaagtagggaacctctccagtaggtgggaacatgtgccaaggcatgaagcagtgaaacaaagtggtgcgtgcaagagaagtactcataatttgttgtggccagacacaacatgagagggagaaaatcaagatgagctgatcagggaggcctaaagttaattttttcattgtgcttatcttggcttgcttaccatgtaaagaaccttatagctttccacatggggttagttatattttattcacttactgataaataaaaggataatttatgttgaggaaatgtttagatgcagcctattctgagaatttatgtatttacttttatttctgcaaggtgtttgactttttatctagtcattggctgatagtcctctcaatactaataacatagtagagaagatgatgaaaatgttttattcatctgttcttggacaagaaaccctgctctttctgttctttttagttgaagctgaataaagctgaatgttctagtcggaagcatgggttcaagtttctactacactgtttctgagcaggttacgtctccttcctgggtcttaatttctccagttgtaaaataggggatttgaggtaaattagcatatccacattgataaaaatttatctgggctgggcggggtggctcatgcctgcaatcctgaggtggcgggatgctgagatgggcagattacttgaggccaggagtttgtgacaagcgtggccaacatggtaaacccctgtctctactaaaaatacacacacacacacacacacacacacacacaaattagccaggagtggtggcgggcacctgtaatcccagctactcgggaggctgaggcaggagaatcacttgaacctgggagacagaggttggagtgagccaagatcatgccactgcactccagcctgggtgacagagtgagaatctgtctcaaaaaaaaaaaaaaaaaatttatgtgaagcaagaatcaatacatatatgacccattagggtaatttttcttggcagtccttcccttcctggctgctgtttaccaacttaattattcttcctgtttcatgttagattctataatccagtatacatcttactactcttggccgggcgcagtggctgatgcctgtaatcccagcactttgggaggccaaggcaggcggatcacctgaggtcagaagtttgagaccagcctggccaacatggtgaaaccccatctctactaaaaatacaaaaattagccaagcgtagtggcgggtgcctgtaatcccagctactcaggaggctgaggcaggagaatcacttgaacctgggaggcagaggttgtagtgagccgagatcatgccattgcactgcagcctgggcgacaagagcgaaactccgtctccaaaaaaaaaaatcttactactcctctcaactcctgctattatctttgttattttcagcaaccatgtagatgaatccatccaataatatcctggcatagttgttgacctcattatcatttctagtccacttagctctctgccttgtcatacctctgaaatgttccttcactaaaatcgtaactctaggtaacctcctcactacaacctgataatttttttagcttccccatttaattattcttaaagtataccagttctcagacttaccagcacctctattaaatcttttcttcctgtcttttcgtctttactttcctcctcttttagcttagattccattgttactctctctattccatgtcataaattgtttgccccatttttggtcaatttatctggtaaagctgtttagtaaaactttgcctttgcattactgtagtctactgaagaaagccacacaacggagcagattggtgggactgtaaaatgatgatgaatgatgtaggtcagtccttaacgctgcttaccaattctactttttgttcagcgtattttcttgttctctgtattatctctcaatttttttttttttttactcatctcaaatttggaatttccttgctctgctgatttcctttttatttcatggagaaaatagctataatgtggaagcttctttagcttctttaccactaaagttacaaatattttgttacctgtacctgctttttccttttcatctgttgtggtggaagaaatattccttctatcactgtttatgctctcaatccccttccttccttttcatcttttgtggtggaagaaatattccttctatcactgtttatgctctcaatcccctcccttccttttcaagaataactttttttttgagaactttggctgcagagagtatggagagttaaatgcaagctggaagagttgtctagattcactgtctttatttcctcatctcctacccactggagttgggcttttgctcctaccactcctccactcctgaaattgttcctacaaagggtaccagttgacttcaagtcagttaaattggatgacattctttaatgatgggcctccaggcagcatttgttcagcagtccctgactatcttttcttggcttctttaatagcatttgcagtcttgatttccttccacctctctggttactcttcttctgtttcctacagtttaatcagttactacaaatattactgtaacataaacaaataaaggtttattatcttacagagaagaatgcaaaatttgcataaattttgagaaccaaacaggctttaaggaaaccaggttgtggcaggaaattttgagcaggttacacactactctgtgagagatactgaaaaaagttgtgaatcattcatacatgtttcataaatgattcctttcaacaaccttataaggtagatggttgtattcttgtttatccacaaaggatttgaggtggggaaagatggggtatgttcaggaaactgtgccttgttctttccaattggaaggttaagttacaataaggtactactgaagataaaatctgttgtttccatgatatggcgtgtcttgaatgccaaggggagacgttttttacttaattttttagatagtgaggactgaagattttttttttttttttttaaccttgagtggctggagtgcagtggcacgatctcagctctgcaacctctgcctcttgggtttgaatgatttttctgcctcagcctcccaagtagttgggattacagctgcctgccatcatgcctggctaatttttgtatttttagtagaaacacggttttgccttgttggccaggctggtctcgaactcctgacctcagatgatccacttgcctcggcctcccaaagtgctgggtgagccactgcacctggccaggttgaagatttttaagctgtgtacaacgttttgggaaaggaaacctgtcttggtgaaaggttgataatcccataacgttagttttagtgaccaaatggcacttccacttgaagcctttttgtaggctttccactataatgaattgagccttctttgacactcccatagcactttgtcataccttttagcacacttctcatgtgtcataattacttgtttgtatttggcttccccattggattttagctcttctagaataggattattagtttatggttaatgttgattttggtaatctttcctcatccctatctcagtggttggcaaaataaatggttcttgaattagtaaatgaataaagagtttgaattttgaatcttttgtctgaatagcttctcagaatgcatcttttttatatttttactgattaccgggttgaataaattagaagccactcctacttcctctctgctgatacatatgttttagctagttaaacctattttgatagaggagttctatgactttaaaggcctatgactttgcagacactcatacagtgtacagcataccctatgcaaatcagctgtctgttcaggtcttgtgtttgttttccccatagacataatccagccgttagttattcaaagcagcagatgggagaaggaatccgtggaaatgtggatttattagctctcacaatgaaagaccacactggttatgctaaggattagaagatttctgctgaatgaaagggacatggatcctgttttttgtgctattttcagcagtgtggcaatttcttatgactataatcagttgtaaaaagaccagaaaatgatcttgtaaatagactttccttcaagccctagactgttggttgcagctgtcataattataggagggactgcttttcttcctttttgggtgcagactgaatctggcctttagctattgctatatttacaccttaggtagtataactggctgattgtgtgctttatacatacctttatctgtcaaattagggaatttggattcgtgtctcctgaattttgtaggagagtaattattgtagcatgtcttatagtttggaaaaaatgattgaatttaatgtgttaaactcacttcctaaaaatataatgctgccttcactaacaattttgtgtgtgtgacttgttagaaagatcagcaactttcctttgtgtttactaagattctgacaattaccataaagttggaaagtttaaacgttgcttatggagtgtgtaaggaacagaatcatatcatgagaacaatctttcactcttaaaatctaaaagattatgtattttgagccatgaattaagaaacagaagcatctttaaacttggctgaagttctactttaaaaatggcagccagtaaccaaagaaacaattcttgagatcattaaagcttggataaaatgagactttttcatgctgtgcccttttagaagtctgggggaatggggagcgtttcctgtgacagcactgtaagtgataaacagctgaatgaatttgtccatgctcagaactcacaacacgtggactagccccctcctgcacataaaagagcagggaaaccgaccttagcaatgatctagctcctgaagaaagaggctttcgttactgtccaagaagtgaagaccagtgagtctagcgataaagaaacaaaagagcccctgacagtatcgaaagaatctgacatttgctttgtctgtacaaaggatgaaaggaattttgccgacttagtcaaaacaataactggttttatatcattttgagtctaaaatacaggcatcagaatcgtatgtttttctttgtatttctgaagaattgtcatctttttaaaaacgtatgtggagtggttttgtttctggaaaggaaaacgtgacatggattttataagcttagtagctgtaggtggagactcttgttttgtttgctaaacctttttaataagcagcaaagtcaggatatcaaagattggaatttttcccccggaaccttttgttcttttcttagtacttcaaataatttcaaccaaaggggtatgcatggaaaatgaaaacaaatatgaagtctttccgctatttggcagtgcttcagatgagatgtatctatacttctgtgaagaaagacgtgattctgatatgaggcagtgattgtatacttacgctggacagagggataactggtttagtggaacagtgggttagtggtgtgctgaaaggattgtttgcctctttatccagcagtaagtaggcactagtagttgactgtctggggagtggcttttttttgtctgatatctattatggatgattccagtattctgagaaggagagggttacaggtgagtaaaagaaaacctttttcactgatctccttccttttaatgtctcttgtaaatgtactgaacagattgttataatgtatttaattcatttgaggtaggaggcagagtggagtgcagctaagttcctctttattctttgatgtatagttataattagagaacttatctaaaatcttgctattttgatagaaaaatgctgcttgggcttatttacactgtatttagtgagtagagcaactaaatcagacctgtatgggatacaagcctaatttagaacattagacattactgctgacagattgtttacggtgaacatattctgttcctgaccaccatgcctgatctgcccaccattaagtcacatgtatggtagtatatgcttgattctatgcatagttttaagaacttttctaaattatcacttggcatatacacattccatccacttatctattgtctgtctgtgttgtctgtccatccatccgtctgtctgtctacctacctacctacctaccatcttttccttcttaaatcataggtagtttgttagatgaagaggtatgtaagatataacagtgaatgaaaatagactgataggcaaccttcaactgagttttaatgaatatccttagcactaaaagaatacatgccaaatttgatgattatttttttcatgctttgtagattatctcatcttagtcttgttagcaaagagcaagccagcttctagtctatcactaaatgtttttgagaattgacataatgaagattctagtgtaaatcactgagctaatcaatcaacctgtgatggtttagtcatgaaatgtagctatttctgttgttttcattttgtttatttgacattatttataaagcactttttttgtacaaaatacctaaggattttaaaattatcatgaattaacattattttagtttctttaaagttctcaggtagaaaatgtataggattagtaaacttaaaatataaatttaaacaaattgtattgtttctagttattatatgtacttcttattgatggtgctgtaaacattcagagcccgtagggagaacccactgaatctttagcagttgaccagtatgacctgggctttaaaagtcaataacataaactccagcgccttatactaatttctcctgttagcacagttgattcgatgagatttgtcccttgatttcttggggttattttgagtagtatttatttagtactgtactcagatgacctctcataagtagtgatgtatgttcaagcagctgctaattaaaaatggctggctctgtaagcccatttagttgcactgcttatttatatctttatttctctttagttgctaggattcagaaagggaatcctatttgttgaatgggaaatattttctgttttgtgttaaatcattcattttctccctgatgcctgagtcagtctctagtatttgctaccttgtttactgatgcccttcctctcgagtctttgtttctatctagcaggagttctaaactgccagattacatagcactggaagatcttttcctacagccttatacttataaaaaatttttcccctatttattttgtctacttttttttttttgagatggagtctcactctgtcacccaggctggaggtgcagtggcgtgatcttggctcattgcaacctctgcctcccaggttcaagtgattctcctgcctctgcctccggagtcgagtagctggggcattacaggcatgtgccaccacacctggctaattttttgtatttttagtagagacggtgtttcaccatgttggccagccgggtctcaaactcctgacctcaggtgatccacccgcctcggcctcccaattgctgggattgcagatgtgagccaccgcacccagcctattttgcctatttttaaaaaataaactttaaggttcattctccagaagattgctttggaacattccaaaacagagctaacgcttgaaaagcagcagtttagattatttgttttaaatagttacattataatataaagatttaaaggtaagttttattaatagatttatataaataaacacacaaaggtaaagtgtgcctggtggtacaggtaatctactgggtaacctcagatttgaaggtgaaaatccaaataaatatttggcttcgctaattgctttctggtgaaatagatttcctaaaacttttccagaagatcagctaagacacagcctactttgatacctccaggtttttccgcagagtttcttggggaggtagcagaatagtaaatagggcatttagaagttccgtgacagcaaagaccttgtctattttgttcaaattacagttctgccatgttctagtcatataaccacagccaaatttcatttcatttctgtactccactggtatattgagagtagacagtggaggcaagggctgcagcaaaaagaccaattatgagactgttgtggtcaaaaaaagcaagaaataataacagattggaggggtgatagcagtggacgatgtggaggactttcttattggccatttttacagatacgtgaagctcagtagcttcctcaaggacagacaagtaggtgtatggccaggctagatgtataggttagggtactctgaactacaagtaacagaaattttgactctgagtggtttaaatgttaggtaaatgtattgactcacaacaatgaagtccagaggttggatgggtttcagagttgggtagtctggtgtatttgctcagcttcattgctcttttgccttcctctgtgttttggcctcattctcaagcttgcttcctatgtgttagaaaaagaactgtagcagtttcagtctgcacagtcacacactacaacatccctacatcttaatggtaaaaggacatctgggagattatgtgtgagcatcttttctttacactggaggagcctctgtcggtgtaggaattgacactgttttgcttgaaaagctgttcaagttgggtcttttttgtggtaaaaattggctttcatcttacatctacttttgaagcatctacacatggagagacatttgagattgaagttccttgtgaattgaaggaggtgcttttatacttgccctgtttcccaatcaactttatgggggatgattttaactttgaaaggtcagggactagccaccataagcaaatttttgttatcaactctcttagtgccataatttccacattatttgcccataaggcacatatagtaatctgtcttcattgtatagacagtgcaatttcccaggttctgaattgaaaatatttgttgtgctgataaaattattgccttcaggcaaaaactaaattgtatagtatttttatgcaccccccccaaccccctgcttgctttttgcctttgctgttcaaaaacgagagtacttagagtgtcattgtttacgggtacttaattattttggaggatatatgacaacataatgcatactgggaagcattattattgagaaagccttgggactttttttattttgcaaattatgactgtcataaattatggtcatcttacaaaatgtgattcagctaatttttagtctttaaaaacaaaatcttcaagaaccaggtagatttcaaacattcaatttcttcttgaaatttcattttaaaaaggctgatgacatggataaaaatgtaacctaattatttgcttctgttgttctacatttccttgttcttttctgtgggaagcttgataaaagaaacatttcagtttgtactcttcagtttttagtaccactaagatattttcatcaagtcagtaaattagatggctttgaaggttaaggaatttatctcactcttgtccctcttctttgccctgactcatgtattcctattctatgttgcagctacaccagtcttgtacctttgtttgtttttttcatagtcatttttttctgacattccccccattcctgagtggttttatcctccttttctacctatcaaccttctgataatccccatgcagttaaaacctgagtacctaattttcaaatattatagtcattatgggtaactccagtatctttgtagacaaggataatcagtccagcctcagatctttagagttccttggctatctggagtctgtgttaacaatacattcctgtagatgccatgtattctgtagagggaactgtttgattcagaaatcttacagtgatttacagttacatcccttgatcacctctgaattaaattctggtgttctctgtgtaaatctagatcacaaattggtggtctggtgactgtttcctgtagatatattttatttagccacctttggagatttaaagaaaaatcaaccaacatagtctctatcagtccccttttgttttatcctctgctgctttatgtatttactgaatttcatctattctaaggctcacatctttttactttataacagctttgaaatagcggtgttactcttgatggtgtgttatacgttaattggccaggcttatttttgttttgcattttaaaaaatgtttcttactgttacaaaaaataacagtgtcttttgcaattgatagtttttcagatttgataaagtacagtatattaccttactggcttattaaagcatttgagtttgcaccatttgtttctcaatgtaaagacctccacctttttttagctctctccctttcctttttctaaagtcttgaagatctctgttcctgtgattcttttgtttgtttgtttgtttgtttgtttttgagacagagttttgctcttgtcacccaggctggagtgcaatggtgcaatcttggctcactgcaacctccgcctcctgggttcaagcgattctccagcctcagcctcctgagtagttgggatcacaggttcctgccaccatgcctggctaatttttgtagttttagtagagacaggcttttgccatgttggccaggctagtctcgaattcctgacctgaggtgatctgcccaccttggcctcccaaagtgctgggattacaggcatgagctactgcgcccagcttttgattctttgtatacctgtttgacatgcctttctgtatcatctgatattgttttattttttctcaatttatttgaggtatataacatttgtgaattttttattgtataaccacattcacattttgttggtaaacccaactcaggaataatgtatgattcagttttttaaaatgctcatgtatataatgtaagtttcctacttttcatcttgaggtagttttggtaaggtatatgtttttaagagtttgtccattttgtttattttgttatttattgagatcaatttgtttatatatatatatatataaaatttttgttcttttaaacctttgctgatttgttcttctgtttctctttgtatttctaatattgggtattaagactcttttttttcattatcaagtatcagtggaatgccgagtacagtggctcatgcctataatcccagcactttgagagtgccaggtgggtgaatcacttgagcccaggagctggagaccagcttgggcaacatggtgagatgtctgtacaaattaaaaaaaaaaaaaatttaagtagccaggcgtggcggtgcacacctgtagttccagctatttgggaagctaaagtgggaggatcgtttgagcctaggaggtcgatgctgccgtgagccatgattgtgcccctgtactccagcctgggtgacagcaagaccgtgtctcaaaaaaaattaaaataacaacaacaaaaattcatggaagattttttttgttgttgttagtttttccagaaaccaactatccctttatttcagccttttcatatcagtttgcttttggtatatctcttgcaaatggcatacagtaggttttctttaaaaaaaaaaaaaaaaagtcctgtttgtaatgaaaagtttgtctgtgtacatttattatgattaatgatatatttggacttgtttgtgccatattattttttgtattccatatcctacatctctatgccttactgtccccttttttttttaccctttaaaaatattggtagagttttttttcttattttctttttctatttctactggtgtgttagaacaaattcaaactttaaccccctcctgaacactacaagcactccatgtctcttattacctcccccaaacttatttggccatgtaatcaaactgaactgaaacaggccagtttaaaaaacaacaacaaaaccatgaaattcactgtaaccagaggtgacccagtttacctgagctagcatgataagaaagttctgttttaactctataaggagagtcactttgtaatgaataatctgctttttgttccctgtttgtgctttcttaacccattttctgcttagaaagccagccccctctgcttagctcagcagaacacgcattctatttttaagaatgagatgttacagaattgcaaacaaaagtcagtttgatctttaaactgaaagtcagtttgatctttaaactaaatctgttgtaattttgtcctttgacaatggtattgtcatcagcagtggattctgagtaggccctagaatgttcaccactcctaccctaagcccaagcagtgttatttatgttagttacattatgtgggtttaattatgagttatatcaagagacatataatattttagtggcagagaatacctttttttcatcattgatttgtttgtttttcttgagttctcactatgttacctaggctggtctcaaactctgggctcaagtgatcctcccaccgtggcctcccaaagtgttgggattacaggcgtgagccacagcaccttgcctcgttgattttaaatgttagttgaaaagttattgtctccaaaacccaattctctatccacttccaatggagtggattattgggttatgtttcttagagtctgttaatttccttctctggaaagagtgctgctactgcagtagggatcaatatacgtatagtgtgagaattcaatagcaaatgagccaggctgagtcccagggagggagttgcctcaggcatagacagctttgacccatagtcatctccacgctggtgactgttgacataaaggacaaggaccagccttgtgactcctggcttgcatatttacttgtgggggtagcggttactgcctttggacacttggcctttgtcttttctttggaaatattttatggctttagtcattgtgaataatgagtagtgcatataggcagtgaatcctcatctgtgggaatagcaccatttcgtggtttttttttttttttgagacggagttttgctcttgcttcccaggctggagtgcaatggggcaatctcggctcaccgcaacctccacttgctgggttcaagagattctcctgcctcagcctcctgagtagctgtgattacaggcatgcgctaccacgccctgctaattttcttatttttagaagagacggggtttctccatgttggtcaggctggtctcaaactcccgacctcaggtggtccaccagcctcggcctcccaaagtgcttggattacaggcgtgagccaccacgcctggccatgaatagcaccatttcatgttttatttaatacctttagaagtttgctttgtggacaatgaaagagagtgactggttatttctctaggatttagtatgtataactttctttgtaacttcagaatatagtttaatatcttttattttgttcaatatagtcaaacattacttaaagttctttgggaaatatcatcattggcagaaagtatcaaagtgtatcaatttgagggtccaaatggtaataaaattttggagactgttaaaacaatataccttgaatatttggggtggagtgatagggatggagtattgggggtggggttagtttttagagaatagcatcttatcacttagctttagagcttcgctactggtgggttagattagaaaaatgcagtttcttcttcctatttttttttttttctcttttttgagacagggtcttgctctgtcacccaggctggagtccagtagcatgatcttggctcactgcaaccttcacctctggtctcaagcgatcctcccacctcggtcccctgaatagttgggactacaggcgtgcaccaccactcctggctaattttttttgagctttattattagagacgaggtctcactgtgttgctcaggctggtcttgaactcctgagctcaagggatcctcctgcctcagcctcccaaagtgctgggattacaggtgtgagccaccacacctggtcaatttcttattattaatccaaagtgtcttactttaaacttttaagtttattttaaaaattcaagcctaggaataacttttgtgagaaaggcagagtaggtatttttatctcaggtgaacaggtaagaataatgaggtttagaaaggtttaatgactgaccaagattttataaggaagtaagtagcagaattgcattcacatatttttctgagtcctagtttctttataccatgtagaaatatcctgttaatatcatcaagctgttcatcaaactcaaatgagaataacacattatttatagaataaaggtttttgtttgtttgtttttgttttttcttcttgagacagaatctctctctgttgcccaggctggagtgcagtggtgtgatcttggcttactgcagcctctgcctcccaagctcaagtgatcttcccacctcagccccctgagtagctgggactgctggcacatgccaatatgcccagctattttttgtagtttttgtagagatggggtttcaccatgttgcccagtctggtctcgaactcctgagctcaagcaatcctctcgcctcggcatcccaaagtgctgggattacaggtgtgagccactgtgactggtctaaagtattttcatgtacgttactttatttgacttttacaactgctgtatctaagcctttgaggtagatggaatcccaggtcacacagttacatgtttttgagccacgacagaagcctagttttccaaactttaaattttgtgttcttgaccaggcatggtggctcacgcctataatcccagcgctttgggaggcggaggcaagtggatcacgaggtcaggagataatgttccttttaagactagatagtaaatgatattaacatagattttcttcctcggtaatatttttctcttcttaaagcattccgactctccatggagtaactaccagccaggagactgtcagtaaataatatgtgataatagagcatattcttcccctagtaaagcttcttgctgaaattattgcaattgatagttttcatcaatgcaactccaaactggtaggcaggaccctattgtcttataattgccttataatgatgataacaataatagtatgaaccatttacttacttgatggattcatagatttattcatccagtattcatttgttgcctactaggctaggtattctgctgggtgccaggaatgtccttgagagcaagactaattcctactctcctggagctaacagtcaaagaaaacagataatttagcaaataattatagtaaccagtgaagtaggtatgattgaggaattaaaggaatatttggataatatatggaaggaggctggggaaactgtagaaaaacttgccagaggaaacgaagtttaagctgaagtccaggaatgtataaaaagagataaagaaaagtaatccagaccaggagaacagtaagtgtgaagacctgaaggtgaaagaaagcatggcaagtctgagtccaaaactccaataagactggagaattatgcaaatgatactgaggagggaggcagtcagagccaagtagtgccctgtagactacagaaaggattttagactttatccattgcagaattataagagagaaaggacacatttaaaaaagttatttttggccgggcacggtggctcacgcctgtaatcccagcactttgggcgaccgaggtaggtggatcacctggggtcaggagttcgagaccagccttaccaacatggggaaaccctgtctctactaaaaatacaaaaattagccggacgtggtggcgcatgcctgtaatcccagctacttgggaggctgaggcaggagaatcgcttgaacctgggagacggaggttgcagtgagccaagatcgcgccactgcactccagcctgggtgacagaacgagacttcatctcaaaaaaataaaaagttatttttgacttcagtatttatttcattatacccacagttatcactcagaaaacaggtactatatatgatatttacattgatataacattaatcaagggggacaaaactgaatgaaagggagaccaattaggaggatgttataggatgatggtggcttgtgcccggggaagtagaagtgaattgacagattaaagatagatattttggaagtagaattggccgagcttgatgaataatggatgtagagagtgagagaaagtgaaaaatgaagaatgaccctgggtttggtggtaccatcatcaaaatagagaacagagaaggagcgagactgagtagaaagatcagctgagttttagacatattaaggacaaggtagttgtatgtacaactatagaggtcagcaaaaagatctgggatagagatacaaatttgagattgtaaaatatatagagaaaggagagtgtacaagcagaactaaaaggacagtccccatttaagggtctaaggtgatgaaggatgagcctgcaaagatgtttaaatggtgtgtttgcggggataagaggaaaaacaagagaatgtggcttcatggcaagaaaagtcttccaggacagaagagtgaatgatactatcaggtgctgttgagcagtggagccaaaaaagataggtggactaaaaatgcagtgaagcttcattaccctggcgttatacattacattggcagtgtgccaagaatggtttaaatgggctggtaaggtctagggatatttatagagtgttgaagaatgagtaggaagtgagaaattagagacattggatgtagataactcattcaagaagtgtggttgtgaagggaaataaaattgataaggcagtatttgaagagggatgtgtagttattaagggaatttatttccttatctgaagctggaatagacttgaatgtgttcagaatgctaatcaggaagatcattaagaacatgaagagtcaagagataatgagtagatcagagaaggctgaatggaatgggcttcacctgatattgtaatgtattaccaggtattaccagcctagttgctggaaggttatgagtaaaataatttatggttatctgtctaaatgggagtactcttgcctcagccaagtttcctgattgtgtagcttttctccccaacttgctgtgaatattccctgggaaaaggaggattgagaaatcattgctccttggactacctttatgtggttgggcccttcttgttccactgtgccttagttgtcacagaatgtactgatctggagtcctgggcatcaaatgcaggcttttgtataggtgtaaggaagtcggaagggatggatttccacggatgcgcttccgtgcctctaaaggaatgcagagaggggcatatatgcattttaggaaattttattattgttagccaaaactgtagtctaccatattacccatttaaactattcaagaagtcagaactgtcatgtagattcaaagaacaaatatttccagttttatatagattgtttcagaaagtagaaaaagaggatatattaccttagcacattttatgagtgtcttcgtctgttcgtgctgctataaaaaaataccacagattggatcatttataaagaacagacatttattttctcacagtcctggagtctgagaagtccaagatcaaggtgttggcatttgtgtggtgagtgccttcttgctgtttcttcacatggtggaggatggaaaggcaaaaagggctgaaagctgtatgaagcctcttttttttcttttaattttgatttttttgagatggggtcttgctctgttggccaagctgacctcagactcctgggcttaagggattctcctgcctcaatctcctgagtagctgggactacaggtgcacatcaccatgcctggcttaaagccttatgaaggccttaatcccgtttacaagagagaaggcctcatgacctaatcacctcctacaggccccacctcgtaatactatcacattggattttaaagtccaatgtgaattttggacgagacacaaacattgaaaccttagcagtgaggatagtataagtatgaagtcaaaattggacaagaacaatttgagacgagaaagtatataggccagtcttacttattaacatacaggcaaatatcctaaataaaagtttctaggcctagatacttttattagtgaaagctgttaatatttaaggaagaaataacaccagtcttacataatttctttcagaaaatagaggagtaaggaacagttcccagtcagttttaggagaccggcataattgtgatataaaaatctgacaaagaaattataagaaaattagagattattatcccttatgaaaataggtgcaaaaatcattaaaaagatattagctaatagaatctagcaatgtatttgataaaattgaagttaggttgggcacggtggctcacgcctgtaatcccagcactttgagagaccaaggcgggtggatcacctgaggtcaggagtttgagaccagcctggctaacatggtgaaaccccgtcgctactaaaaatacaaaaattagccaggcatggtggcacatgcttgtaaacccagttacttgggaggctgaggcaggaaaatcacttgaacctgggaggcagagggtgcagtgagcagagatcacgccactgcattccagtctgggtgatggagcaaggctctatctcaaaaaaaaaaaaaaaaaaaagttgactttaactcagaaatgcaaaattagtttaatcttagaaaatcaatcactgtaatttgccacattaacagaagagaaaaactatgtaagcatttcagtagatgcagagaaagtatttgacataatccatgcccatttgtgagaaagactatgaacaaattaggaatagaagagaacttgataaaaagttatccatgaaaaacctataactaacataatattaaatattcaaaatgttaaatgcttttcttgtaagatcagatgagaagcaagacgaggatgtctaccacttcatttaacatcttatagaaaattctagaaaatggaaagaagtaaagctccctattatagaagatatgattgtttatatagaaaaaatctaaggaatgtacaaaacatttatgattaataataattttaccaaagtataggatacatggtcaatataaaaattaattgaatttctataaacatgcaagcaattggaaaatgaaataaaagtttttatttataatagctttaaaaaatctacttagggatgagcttaataaaaggagtgcaaggtgtttttgttaaaaacgataaaacattgcttagagtaattaaagaactcggtaaatggagaagtactatgttcatgtattataagacttgatattttgagatatcacttctttccaaattgatgtataatcccagcaggcttttttttttttggtaaaaattaataattggattcaaaaattcaaatcgaaatgcaagaatctagaatatctaaagcaatcttggaaaataataaagttaaaggactgtacaatctgactttaggactaaatataaaaccacagaatcatgatagtgtggtgcttgcatagggcagaaaaatagatcagtaggatgcaatagagagcccagaaaggttaaaaaaaaaattgttagggaaaggacagtgttttcaataaatggtattgaaataagtggatatccatatgaaaaaaaatgaaccttaatttcatctcacatactacctcaaaattaattttcactcatcaaaaggctctactggcctggcatggtggctcacgcctgtaatcccaacactttgggaggttgaggcaggtggatcacctgaggtcaggagttctagaccaacttgaccaatatggtgaaaacccatctctactaagaatataaaaattagctgggcatggtgatgggtgcctgtaatcccagctacttgagaggctggggcaggaaaatcacttgaacccaggaggtggaggttgccgcacgccgagattgcaccactgcgctccagcctgggtgacagagcgagactccatctcaaaaaaaaaaaaaaaaaaaggcaccaccaataactttagtaggcaagccacagattagaacatatttataaaacacatatgacaaaggacttgtatttagaagattatgaagagctcttataattcaatagtaaaaagataactcaatttttaaaaaggtaaaaaaattttaagatacttcacaaaggaatatatattgatggttaataagcacatgaaaagatactcaacatcgttagtcatcaggaaaatgattaaagccacaatgagatacccgtacacacctaaatggctaaaatgtaaaatgactaaaatataaaaagctgataccatgtattggcatgaatgtagagtagttcgaactttcttatattattaatgtgaacataacatgtattagctaggatgtgaagcagttgaaactctcatacattgttaatgggaatgtagcatggtataatcactttagaaaaaggtctggtagcttcttataaatctaaatatatatctaccctttaactgagtaattctacacttttagggatttacccaagagaagtgaaatatagcttgtcaaaaaacatgttataggaatgttaatagctgaaaaatggaattggagaaacgataaattaactggggtatattattcatattgccattgttacctgcaacaacatggataaatctcacaaatactatgctgagttgaagaagcctatgtaaaaaggtttatatttgtatggttccattcatatgaagttttgaggaagtaaaagtaatctgtggtgacataatgagaataatatttgcttggggtaggaagatagtggtttgtttggggatttacgaagaaaggacatggtggaactttctggattgatggacatgttctatattttgatagagatttaggttatctgagtatatgtacttaacagacttatcaattggcatacgtaagattaagtaatttaagatttgtacagttgaatgtttgtaaatttacctagaaaaacacacaaaagaattgcaatcaaatactgaattttagcaaaaataattttataaaataagcgaattttacaaaaataaggcatattaaacttattgtgaaaagtaaaccggctgggcgtgatggctgacacctgtaatctcagcactgtgggagaccaaggtgggaggatcacttgaggtcaggagtttgagaccagcctggccaacatggtgaacccctgtctctactaaaaatacaaaaaaattagctgggcatggtggtgcatgcctgtaatcccagctggaggctgaggcagtagaatcgcttgaacccaggaagtggaggttgcagtgaaccgagatcggccagcctgggtgacagcgtgagactccatctcaaaaaaaaaaaaaaaagaaaagaaaaaagcaaatctataaaatgtttagaagaaaatataagcacatatattcatgactgtgtatgagggatatatttcttacatggacagttgttttggagagcaatttggaatatccagtactttatgactcagtagttcaacatccaagaaactttttctacatgcgcactaggaaacaactacaagaatgtttacaagagtattgttttaatggagaagaaaaagatggaaagaaaattaaatttccatttactagagaatagataaataaatattggtatattcatagactggaccactgtctgaagatcagtgaactaaagtgaaatatatccacatgggtgaatctcccagttttcataatgttggctgatgtcaacagaggaatacatataatataataccatgtatatataattttaaaacatgtaaaacaatactactaattttttacaaatccaaaaacacgtattgaaaatatttaaaaaattaagaatagttgttaatttaggactggtgggaggtgggacttgatacacttggaaagcaagtcacaggggccccagctgttatcgtaaaggttatttcttatgccagtggtgtgtgaagtcatctctttgttatattattaactatactactttatttgtctaaaatattttctagttatcacccactgcccctaatcctatttcattccttctgtatgcttgccactaatgccctttacaattcagcagcagttaatggctggcctagagtgcctgtaatctacactggggagatggttccatctagtgggaaaaatgttgcatgtattctatgagacattccttttaggaaggaaggataaagaagtaatagtttgcctgagtgcttttatttcacaaaaatttaagagacaggctgggcatggtggctcacacctgtaatcccagtactttgggaggccgaggcgggcggatcacgaggtcaggagatcgagaccatcctggctaacacggtgaaaccccgtctctactaaaaaaaaaaaaaaaaaaaaaaaaaaaaaattagccaggcgtggtggcgggtgcctgtagtcccagctactcaggaggctgagacaggagaaaggcgtgaacctgggaggtggagcttgcagtgagccaagattgcgccactgcactccagcctgggagacaaaatgagactccgtctcaaaaaaaaaaaaaaataaataaaatttaagaggcaaagaaaaagttgttatttagaaatatgtggccttttccattattaagataatgctgtgaatttcctaggacatttaggtagaccaacaggactcagatgggttcttatttctaacttgcatatgttttgtttttcagaaggagttgagccttccaagaagaggcagcttgtaagtagatgattattaccattatgattatgatctcctacttaggaacccctcttgggaacatttcccactatcatgtggaggaatcccgctcagtacacaatttctttctgtgtactcctatctgagctagggaagccagcaggccaactgacttctcccactaggtcagatcttcccctcctccccattcctcccgacctccaaacctcttccctctcagtttctacatagcattctgggaaagttacaacttaaatattcatcacagtcttatacttgtgctttgggatttactgagttttcgtagactcaagctaaggaagtaggaatattaaaatggaaaccctttgcatttacatctatccggtaacatggtatgaggagaagaccaacttttctgataagttgaggcaaggccagctaagtttggagactatgttgaatggaataggttcccaacctgtttggtttttttctggcttcagggttaggggagattaataaatagtctttgcccctggattttaatttcttaaattctcttggactgcttttcctctaggaattctgttggggcagtattagaaatttggccaatcagaatctcctggaatgtttgttaaagtgcagagtgtgaacttaatgcattaaaatctctgtgttggggcccaaaaacctgtactgtatatacctaaaacatactcatatttaccatgatttactagtaaagtcacatctggggaaccctaaggaaatagagctgtgataaaacaatggcttttaaacttttccttaacaaaaaaagagatgtaattaaggaggagatcacaacagcattcatatttattaagtatactttatatacacatcatatgcaatttttaaatgtttaaatgaaacatgtagtaattctttctgttactgtccattttaggattttgttttgtgaaaaatgctctagtgattaaattttcctctgaggtttttgtgaagccttttgggctgtttacgaaaacttattttggtttgatatgaagaggcttgagtcagaaaactcataaggttcagtcttgaccatgccatttaactagctttgtaaacctagacaaatcactttatcttcttaaacctcagttgccttatctataaaatgaagataatgttacctgtgttttcttcttactaagcctgttagaaggatcacttaatatatgtatagtgctttattacttatagtttaattttaatatatattagttttagaattcttaatgggttaaatttggatgaattctattatttaagaggcacattttaaattttaaattcagtttctagcagtggatattcagtctagcttcacaagtgtcctgagtcttctgtaaatggcaagggctctaccaggactcttagaggaatgagacaccaaataggtatgcataactgaaaaggagtagcttttcagcatcatagtcaggaaatatttgtacttggtcatttttctactatttctgccccccccgcttttttttggttgcttctatttgaaaactgcctgagatttgccttttcttagtattaagtgaaataaattaaggcctgagacaggtagcttcttgcagaaatgtgtgtcctcaatgaatggagttgctgggaagaaggagaaggaggagtattcttatttttattttataccagaataattttttggtcattttagtgatatctaaagttaggcctactctaactgccttaaaaacgtttaattaataaggatcagaaatagattttccctcctcttttttgataaagtaactcacatttaaacaattgatcactcagtaaatacacagtaatatctactctgggtcaggtgcggtggctcacacctatagtcccagcactttgggaggctgaggtaggtggatcacctgaggtcagtagttcgagaccagcctgaccaatatggtaaaaccctgtctctactaaaaataaaaataaaaattagccgggcgtcatggcgtgcgcctgtagtcccagttactcagggggctgagacaggagaattgcttgaatccaggagacggaggttgcagtgagctgagatcatgccactgcactccagcctgggcgacagagtgatgcgccgtcaaaaaataaataaataaataaataaaaaagcctactctgtgctgggtagagtgatctaagttctgaggctgttaagattcaattagataaattcttctcttttgaagagcttacacttaagtaagccagaagttcttcagttctttaatataaacaatatcctttcttatctttaacattagaggagtcgaaaaagttttgttctggaaggaagcaaggaaacatgggtactaatataggctttgccactaacaaattatgtgtggctttaaaacaggagctcccacttctggacctgaattgccatacttgtaaaatgaagggattggctacctgatctctatgcttagtcatctccccaaacagttaaagttccatggtacctcttgtacacagagctgggcaagtctttgtagggagtgtgcagtaggaggcaaagtactgcttagcatttgtagtaaagaaaacaggtaagaaccacaaaacaaatatttgaataagtttaattactacaaaatttgttgtgtggaaaaactgatgttaataaaatgagtgacttaccatttgctccactgtttctcgtcctcatagcctgatctggaaaatttttaaagtttctataattgtcatttaagtcttggtcagaaggagggggcatcatatttgtgtccctgtttgcctttcttagaatggttctcccaagagcgaatcctatggtgtgctcattccaggttataaaggcccgtttcctctgatatatccttcatggacatagagaaatttagaatttgcctctagtttggtgttcttgtcctttgagagagcgtttttgttaattaatttttgaggctttcaattgctgtgcttttcacgtaatatgttagttgcattaaaatggacaggaactcaaatatgagtttctagacttatgtgacaacttggcattatacaaaatacacattcttccactcaacaagtaattcctccaaagtctccaaattggtaagtggaagtatagcataaaaattaacagcttgggtttgcaagtcaggcagatgtgggtttcagtcacggcactattacttactagatgttttttggtaaaatcagttactatatttttgtctttttgcctccattcactttgtcatttgctcaaatctttccatccatgcatccatcatactatattattttagttccagttaggtgtaggcactattctagatactggagatacagtagtgaataaagcagacaaggtccctgtgctcatggagtttccattctacttaagagagacaaaaacatgtatgatatgccatatggtacttactgctatgaagaaaaataaagccagatatcagagaggaggatgtgtgtttctgtgggggtgagggtttaaattttaaattttaaattgaattgtctaggctgggtgtggtggttcacacctgtaatccgagcactttgagagactaaggcaggaggatcgcttgagttcaggagtttgagaacagcctgggcaacatagtgagaccctgtctctacagaaaaattttaaaaatcaaaaaattttgtattgtccaggaattttctcattaaggcaacatttgagcagagaacaggagtctggaatgagtgatactgagatagagatagatcgataaatatatatgtatatattatatatatttatatacttatataagtatacatatatatttatatattgtatacatatttatatatgtatctataagtacacacacacacacacacacacacacacacacacatttatagtgacattggtcagattagggaagagagctgttacattctaatacgcaaaatgcaaacatcatctatgcctgccacgataagggctttattggggcaaggtggttatgaaagttcttttggcctggctcataccatttattttagatgtagcttcctgaaactaaatcattttcatttttagaaagctatttcatatttaaacccatctgggtatttttttaatgcattaaaaatgtagtttagaatatcagacctaagggagttgataactttgttcaaagtacaatatctgtgaaaagaagattttgaagttctaaagttacttgtatctgtttacccaggctagaagggttttatattttactttttcataattgaagcagctctgaatggcttttcttgcccaatgctatagtgggggcctctttttgatgattcctttcaaataggattgtttcttttgctgttgttgttattttgtttgtttttgtgacagggtctcattctttagcctaggctggagtgcagtggcgcagtctcagctcactgcagcctggtcctccctggcctcaggagatcttcccatcacagcctcctgagtagctggcaccacaggcacctgccaccacatctggctaatttttgtattttttgtagagatggggtttcactatgttactcaggctggtctggaactcctgagctcaagctatctgcctaccttggcttcccaaagtgcttagattacaggcatgaaccacaatgcctggcgactgtttattttgtttgtgaatttcagcaccagtacctagaccctgcatttgggagcttaatgtaaataatgcttatgtctccagttaccctgaaagtaaagcttttctaatacccattaggcttaagataattttcctcatatttcatgaaatgtcttgctttatttcttagaggctatgagcagtcaattgagataacagactgtaggagtggagaggtagctgttggttgcattcatcatggggtatgtgtatatgtgtgtgttgatattattggcattgctggcttgtagtctttagagcccttggggatagttaaccttttattttgtcagcttattcatttgggcagtggacttagataccagatattggatgaaagttaatgtctggtgtctgcagtgataggcactgcatagtgggcagggaggagttcctgggccccagggatgtgatgtgtcaaactttgttcctatgaaactgacagtgtcatgtactttcccattctgatgcaacttgatgcctggatcaatgcttctggaaaatgtgctaaaaagagataccacctgctgcatacacataataaaccctttgttgaggtatcagtggcgtctgatatagggctttaggttttctgtggggctttgaaaatcaggaaattttgcaatctttcaagactctaaagcccagagtgatagctttgtgttacatttaagaccctgtcttttaaaagttggtgggaagtaatttcatatagattctctaagtgtccaatgggaaggcaggacgtagcagaggttgggagggaagtagccatagtcatcactcatatccctacagggaaccagtttgttgttaaaaaatggatgtagttgttggcgagctttacctgtgtaggtgggatctgaaaatccttgagaacctgtttttgttactgtatgttgagaatagttgtcatgctcattatccccacatttatatcgctagatctcataactgtccattcaccataatgtgactgaatatttcagagacatctgaactgcagcatttatgaatctgagtcattgtctttctcaaaaatcaggtcctctcttatactctagcttattaaatggtactgcttcctcaagatagaaaatttagttatttttgttgccatgctcttccttacactcacaagtcttttctgttatacctctcaaatatctcttggtgttctgtctttatttttattttattttatttttttgagactgagtctcgctctgtggtccaagctggagtacagtggcgccatctgggctcactgcaagctccgcctcccgggttcacaccattctcccacctcagcctcctgagtagctgggactacaggcccccaccaccacgcccggctaattttttgtgtttttagtagagaccgggtatcactctgttagccagtatggtctcgatctgctgaacttgtgatccacccacctcggcctcccaaagtgctgggattacaggcgtgagccaccgcgcgcggcctcttttttttttttttttttttttttttttttttttttgagatggagtcttgctctctcgcccaggctggagtgcaatggcacaatctcgcctcactgcaacctccgcctcccaggttcaagtgattcttccgcctcagcctccccagtagctggtactacagatgtgtgcaccacgcctggctaattttttgtatttttagtagagacggggtttcaccacgttagccaggatggtctcaatctgacctcatcatccatccgcctcggcctcccaagtgctgggattacaggcctgagccactgtgcccggctggtgttctctctttctttatactaccactggtttgtccagatagtcacagccattgtaatctcttgcctctgctactgccataacctcctaactggcctttctttatctggcattgctcaccctcagtctacctaactatcatacaatagccaggaaaagctttttaaaatgcggatttcattattagatattaatttaaacttttttggtgaaatttttttttttttgaaacagaatctcactttgtcacccaggttggagtacagtggtgcgatcacggctcagtgcagccccagccttcctgggctcaggtggtactcgcacctcagtctcccaagtagctgggaccacaggtgcacgccgccacacccagctaatttttgtacttcttgtagaggtggggttttgccatgttgccctggctggtctcaaactcctgggctaaaactacctgccttcctcggccttccgaggtgctgagattacaggtgtgagcctctgcacctggcctttggtgaattttttcttactcttaggatcacacctgactatctatacagtgtggttgctatatttttctccatgttttacacaatgtgttctctgtgcctggaatttttgttttgtttcgttttgttttgtttttttgaggcagaatctcactctgttgccaggctggagtacagtgacgcaatcttggctcactgcaacctccacctcctgggttcaagcaattctcttgtctcagcctcctgagtagctgggactacaggtgcacgccatgacacccagctaattttttttttttatttttagtagagccagggtttcaccacattggtcaggctggtctcgaactcccaacctcaggtgattaagcaattctcctgcctcagcctcccaagtagctgggactacaggtgcgctccaccacgctgagctaatttttatatttttagggtttcaccatgttggccatgatggtctcaatcttttgacctcgtgatccgcctgcctcggcctcccaaaagtgctgggattacaggcatgagcccccgtgcccagctggaatgttctttttccatctataccaatctagttcctacacacctttcaagtcccagcttacacctcacttccttatgaaaggcgttcctgacctcacccaaaccttgctgtctgtagactaagttgggtttcccagaacatactttcaataaagcctctactttttcttcatagctcttacatcagttgtaaataaagaactatttgtctgccttttcccgttgtgtagtatgtaagtattagctcaggctgctgtaacaaaataccacatgcttaaataacaaaaatttattttcttacagttatgcaaactagtagtccaagaaggtgacaacatgctaagtttctggtaaacctctcttcctggcttgcagagagtggccttcttgctgtgtgctcacatggcctttatgtggtacaccagcctgaggataggggcatagatctgtctcttcttctttttcttcttccttctccctccttccttattttttccttcattttcaagcccaacagtcctataggattagagccacccctatgacctcatttaaccttaattacttcctaaagaacctatatggaaatatagtcagattgggggtaaaagctttaacatgaattttggggagacacagtttagtccatagcagatggtaagctccgtgaggtcaggaccatgttgtgcggtacaatatgctgatcccagagcctactatagagtttaacacaaattggcaatcatttgaacttgttccaaacattggtatggtctggcacaagaatacaaatagaggtatacacgtttaatcatttaaaatagagctaccaaattgtaaaataaaataaatgctttgtcctcctacctctagaaatatagttgcataataacaaattttgaaatatgtgtaaagctattgatttttaaaaaataagcacatgttaaatatttaactcattgttagtaaggaaatctggcagatatattagccagttcaaagaagtaaaagaaccacaaagtgatatgtggtatgtgtatgtgtagtgttgaaataaatgtattatttattataaaattgagtttttccatggagagaagggaagtcagttgcaccttcactgtacagaattgatcagcatgtctatagacaaacattattttgtgcactggatgtactagctcacacctgtaatcccagcactttgggaggctgaggcaggaagatcacttgagcccaggagtttgagcccagcctgggcaatgtagtgagaccctgtctctgcaaaagtttttttaaaaaaattagccaggtgtggtggtgactgcctgtagtcctagctacttagggggctgaagtgggaaggttgagcctgcagtgagccgtgattgtgccactgtactccaccctgggtgacagagagagaccgtttcaaaacaaaacaaaaaaaagaaattatttcacataacgtcagttacctacctataacttacagagttgtaaagtagctcaaagacaataaaagacaaactagaagagtattctctaaacaatatgcatagttttttattggaaatatctagtaacctttttttcttttttaactttttccaatttttttttttataatctcctaccttttcatctaaaataatttgaaacgtttttgttcacaaaacaagggtggtctcattgggtttggcctgattatttgcatagtgtggccagaatattaatttatcataaagccttcttaaatttactttgctgtaaatttttataaagaatctcagattggacttttaaaggcctctattatttgtattttgaggctaggaaggcaagcctaagaaataccacatttcacttgtaataactataaatttgggtgaattcctaagggtcctgggccttccaggaagtggccttccttaccatctgtaagtctggaccctgtaaagccagataccaggccagttttcccaggaaggttttgtaagtattggctccataaagtcaaccatagttccttaaaagtggtttgttatacctgatcaaataagcatgattctcaaatgtgacctttcaggcaagctctttgttggacaaccattttttacaattatattctggtcaaaaggagaacagattcttgtttagccctattcaaataaccatattgccttgaactgtaaggagactcagtaagacgttcttagttctgggttaggggagggtcagtgagaatcagatgtgatttaggaatgtttcattttacaagagcaaagtctactcaattgttaagagttatagatagcctaacaaggaatacaactggctcccttgcatattagaaaatggacattaaaataatatttcaaacaaattactataatcatttcttatagttcataccgttctgtgtacctaattctcatttcactggatcttacgttagtagtcggcttcttaactaaaaaaagttctggaaattctgactcattccactggaatgatctggaagttgtccagttgtccaagcaatgctattggaagcctgtctattctttgatgtgtcagtagttttaaaatacctgccgcagtccttttccgtggagctctgagacaacccttctttgttgaagacacagactctggcttctagctgattgtagagccttcagacaggcctcagcacaaaacagaatctctctgcatgtgacagagtctcatatcataagaataatgcaactaacaaggaaattaagttgtttttgtcacatgtaaaatgagagtaataaggccagtccaaaaacttatagcaaactgtaagagattattgcaaataagacagtgaaggttacatctgatttagaaaacatagataaacataatttttagagagggaaaaatctttatgtataacttataatattcttgtggtattatacagacaccaaaaacataccaagaatatactaaggacatcaagtaaagagattcaatgggtctggaataagtcctatacatctatatttttataaaactccagtcctatacatctatatttttataaaactccactgacctagaaggtgctggattgaaatgttaaaagtaaggttgttaccaagtaaacattttcagtttttattatttatttatttatttattttagacaaggtcttgctctgttgcccaggctggagtgcagtggctctgtcatagctcacggcagcctcaacctcctgggctcaagcgatcctcctgtttcagcttctcaggtagctgggactgtaagcatgcatcaccatgcccagcttatttatttcatttaatttattttttattttattttaattttttgcagggggcggggtagagatagggtcttgtaatgttccctaggctggtctctaactcctgggctcaagtgatccttctgcctcagcctcccaaaacgttgggattgcagatgtgagccaccgcacctggccagtattttagataataactgaaattaagactgaaaacacttcttcctgtaggatattttaaaaaaaaaaaaaaagactgaaaacactaaacttttgtttcctaaaatctggcagagttctgtcaggactcagaaacgttatggataatgaggacattgacaaatctctaggagttttctattaatcatacaataactagaatatttatagtaatagcattttacccatacaactttaacctagggaacactgaacatgtcttctggtagataacttttctcatgaaattcattaataacaaaatattaaacctaattatttctaacatttctctaaaaaggagaaaacacgtctttgtgattttgccaaggatgttttgggatatctcagagatagtttttggtattaaaaatacactgaccccagcactttgtgaggccaaggtgggaggattgcttgagctcaggagtttgagaccagcctaggcaacatgttgaaaccctatttctacaaaaatatgtaaaagttagctggacgtggtagcgcacacctgtggtcccagctacttgggaggctgaggtggaaggattgcttgagcctgggaggtggaggttgcagtgaactgagatcatgccactgcactctagcctgggtgacagtgagaccctgtctcaaattaaaaaaaaaaaaaaattacactgaaagttttattttattattttctacacgtaggatctgatttgggaaagacaaatcttcaaataatcgttagtggaaacacttaagataggattgttggtgcttgagaaataatacctggttacttatttaaccgaagtgacggtaaaacatttataaacaaacatagaaagtaacacaattttaaataactgtagttttttttatgaggagccctatgcttgcttgattaaggacctgataagtcagcataaagcacagaaaatttttctagcaagacacaaaatatttgctaactaggcgtattacatagcaaaagaatatactttaatattgtaggtaatggatggcagtaaacagtaaaccaaggacatggactcaccaaaactgaataaattatttgctaaaattttaaccagttttagcttttcagactcaggtattataaaccatgacagccaaaattcacattccgagttgtgcccttcattagtcttcatactctggaacagacttatgctttacttgagtacaagttttaggggttctcaaggtcacaattaatttgataatgagtactaagatgttattaagatgcagtgcatttttagtgttatcatcaaatgaatcagtaagtgttttttaatgtctcagtttccattttcaatactgtaattattgatggttatatcccacagaaacaatttggggtccttcattttatgaattttggcaaatatatatacccatgtaactacaaccacaattaatagatagaacatttttcttacccccaaatattccttctgtagttttgcagtcaatcccatcttccacatcttggcctcaggcaaccactgatctattgtttggcactacagattagctttgcctgtggtagaatttcatataaatgaaaatgacaaatgacctgcttttttgtaattggcttcctttatgtttcagtgtttccttttgtgactataccactatttgatggatatttgggttgtttctagtttttggatattatgaataaagctgctataatcattcatgtataagttttttttttatgggcatatgttttcatttctcttgggtacatacccgggattggtcagcccataaaatcagtgtcccactctgctgccacaaatgggaataacttagctataaataaatacaaaacaaaacccagttatgtaaagaaaaattgaaattagaaatgtggagattccgtaaacttctttgttcatctgggagccaacttcagattaccacttcagatttacctgtgggaaccaagcactgatgtacatggatggtccacgtgaggtgtacttctctgatgtgactcacaggttaattctttggacatttggtggaagacttccaaaactgtttaacagacagtttttttaaaaaaagtaaaaacaaaaaatcatggctttcatccagatataaaatgaaaacattcaaagatgaaagaaaaacagcatatcatcaaagagagaaacaggcaaatattacaaccaattccattatcaatttttatacaattgaaaatggcaaaatgtcaaaaatgacagttgaattaacactgcacatgtctatgtgttcatctatttaaatgagcaataaagtaaaggcaaattcataaattattaaaatatttacacttttctttggctttatttttaccaaaattgttatttgtaatcaataatttcttgtaaattgtattcttttaataacaatgccaaatgaaacagactttcttgaatgactatatttcttagattttttttttttttttgagaccgagtcttgctctgttgcccaggttggagtgcagtggcactgcaacctctgcctccctggttcaaggaattctcatgcctcagcctcccgagtagctgggactacagacatgggtgccaccacacctggctaatttttgtgtttttagtagagatgggggtttcaccatattggccaggctagtctcgaactcctgacctcaagtgatccgccctccttggtctcccaaagtgctgggattacaggtgtgagccactgtacttagcctcttagatttttattttaatatttaccggtttataggatattgcaaaggatagagatgaagagattcatagggtgagttactagggaaggggcagggagcttctgtgccctccccagccgtgtcacttcaataacttccatgtgtgcagccatcctgaagctcactgaaccctgtcctcttgggtttttatggaagcttcatgaagtcaatatttcttgccccaggtgtagggtggaactctctcatgggagagccttaagacccacagtcagaaaggttggggaacattaaagtgaaaggagagctggagaaggtcagaggcctgcccctgaggcctaacgcagccaacattctaacaaaagactgtaactagggctatgggagttgtaagccagaaaccgtagattaaaaccagtatgtatatcataacaccacaggtcaccccctagtttgtgaccacagatcttttatatcaaacaatatttgtatatgcagtcattaatcattagtccagtacatcatattgtatgaatgtctcccaggatgaggccattccggtttgcaagtttcctaaatcttgtcaagttccaaaagcaggattggccttggtaaacacacagcttcatactttcatgcatctggaataattgagcttgagatagtatcatcttttgttcttagactcttttgggctgttaacataacattgaattttcctcagttagtaaccctaactcatttattcacttctttactttcagctatggtttctccttctttccgtttatacccaaattttttcacctctgaaagggacattagaatcttcttgtgctgttccagattgcaggcagcaatacaagtctaggagtaggtcttcctcagtccactcccattcagatagggtaaagttatataggagcagaactagtgagctatttttaccatcaggcaatatagttgcattcactgttagtcccacttttgctaaatggggtgaaagcactactcaccccagtaatgttcttaggaattttgccattaggtttaaaaacatagttacagttttttcttagaaatcatctctgatgtttcagcacttgtagttgcaaccctggtcctaggaccactgcatcaggtaggagagaaaaaataaattttttaaaggtgatttggggaggaaagaaaaaactataggctaggcgaagtggtcatgcctgtaatcccagcactttgggaggccaaggcaggaggattgcttgagctcaggagtttgagaccagcctgggcaacatggcaaaacctgtctctaccaaaaatacaaaaaattagctgggtgtggtggcacttgcctgtggtcccagctactcgagaggctgaggtgggaggatctcttgagccctggaagcggaggttgcggtgagccataatcacgccgctgcactccagcctgggcaacagagcaagaccctgtcttaaaaaaacaaatagagccaggcacagtggctcatacttgtaatcccagcactttgggaggccaaggcaggcagatcacctgaggtcaggagttcgagaccagcctggccaacatatagtgaaactccgtctctactaaaaatacagaaaaattagctgggcatggtggtgcatgcctgtagtcccagctacttggcaagctgaggtgggagaatcgcttgaacctgggaggtggaggttgcagggagccgagatggctccgctgtactccagcctgggcgacagagtgagactctgtctctcaaaaacaaacaaacgaaaccaaaaaaagaaaagaaaaagaaaaaattatagtagttatacaagtgcgctcctcccctggtaagaattgtgtagtcatactagcatcctccccatcccctcttcctcagatcaaccagaaaaacagagaaaaagtcccacgttaagtatgagcacatacgtccttatgatcgcctgtaagccagcccttcatgctttttatctccccctgttttagacaaccaatgtttcaattgcccattctacttctctatcaaactattactctaaggaggatatctcactctgtccattgttggacattatgggctgtatagtgtgttccttggtctgaagaatgatggtgggccatccaaatccatgcaatatcttccgttctgttttttttgttgttgttgtttttgtttttactctgagaatttttatcttccatgggataagcaaagcccactccagagtcagtgtctattcctgtcaagacccctttgtagctcccagggctaccggcatcagtctcatttgccagccatgttcagggccttcctaccagagaatctgcgccatagccatcagcaatctctgtctctgttgctgagaaacagaacagttctttctggcattttgtacctgaaagggtgcaaaaggatcatgtctagattcagctcacctctgcactgctgcattgcccccatactcactttttttcagggactgagttggccacctcaagggagcacatgggatgtctacttatccatccctgtcaccttaatgcatccctcaaatctccttagggccatgctccatatgggcattcttttaacaggccagatttccattgtcctctcacctgagtatatagccaagccattggttacattgcatgaggtcagtaaagactcaaacacaggggcttctaccattgttcaattcttccatcagtcactgttagaaaaatataatgcaattcagcccaccaagcagatctgtttttaccttctttgatcagaggagtagtcttccaaagcaggatgatggttttcatttaccttggaattgccatccatgaaccaaacagctcttgatcaattttttttaattaaattttatttggaggagatttgctctgctgaagcaatagaaattagaattggccaaaaatatttttcctttcttttcttttttttttttttttttttagattcaggggtacatgtgcaggattgttacatggatatattgtgtaatgctggggtttcggcttctagtgaacccatcagccaaatagtgaacataatactcaataggtagtttttctatgcttgccatacctcctctccccttttggagtccccagtgtctattgtttccatctttatgaccacacgtacccattgtttagctctcacttataagtgagtacacatggtatttgattttctgtttctgagttatttcatatagaataatggcctccagctacatccacattgctgcaaaggacaggatttcattctatttatggctgcatagtattccatggtatatatgtaccacattttctttatccaatctactgatggtgggcacctaggttgatttcatgaatttgtattgtgaatagtgctgcgataaatgtaccagtgtaggtgtctttttgataaaataattttcttatgctatgtcatcaggcccaaggggaaaaaaagagctttacaattaaaaaaaaatttttttttttaagatttcttttcccggcccagcgcgatggcttacacctgtaatcccagcactttactttgggaggctgaggcaagtggatcacaaggtcaggagttcaagaacagcctggccaacatggtaaaaccctgtctctactaaaaataaaaaaattagccaggcatggtggtgtgcacttttagtcccagatgcttgggaggctgaggcagaagaattgcttgtacctgggagccagtggttgcagtgagccgagatggtgccactgcactccagcctgggcgacagagcgagactctctctctctcaaaaaaaaaaaaaaaaaaaaaagatttacccttgggtagatagccagtagtgggattgctagatcaaatggtagttctatttttagttctgtggaaatcactatactattttctgtaggggttgaactaatttacattcccaccaacagtatataagcattcccttttctctgcatcctcaccaacatctgtcattttccattctgactggtataagatggtatcttattgtggtttaattttcatttctctgatgattagtgatgttggatattttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacctgcctcggcctcccaaagtgctgggattacaggcgtgagccaccgcgcccggccgatgttggatatttttttcatgagtttgttggtcacttgtcttcttttgtgtctgttcgtttctattgcctactttttagcagatttatttgtttttttcttacgatttaagttccttatagattctggatattagtcctttgttggatgcgtagttggcagatattttctcccattctatgggttgtctttttattctgttgattgtttcttgtgctgtacagaagctctttagtttaattaagtctcatttgtccattttcgttttggtcatatttgtttttgaggtcttagtcataaattatttgcctaggccaatgtccataagagtttttcctaggtattcttttagggtttttatagtttcaggtcttaaatttaaatttttaatccatcatgtgttaatttttatatatggtgagagataggggtccagtttcattcttctgcatatggctagccaattttcccagcaccattcattgaatggagtgtcctttccccattgattattgtggtcaactttgttgaagatcactttactgtaggtgtatggattgacttctgggttctctgttttatttcattgagctgtgtgtctgtttttgtaccagtaccatgatgttttggtgactatagccttgtagtataatttgaagtcgagtagtgtgatgcttccagctttgttatttttgcttacgattgcttttactatgtgggctcttctttggttccatatgaattttggaatggttttttctgattctgtgaaaaacgacattggtaatttgattaaaattgctttgggcagtgtagtcattttcacgatattgattcttcctatccatgatcataggatgtttttccatttgtttgtgttgtctgtgatttctttcatcagtgttctttagctctccttgtagaggtctttcatcttcttggttaaatgtattcctaagtattttattttggttgtggcaattgtaaatgggattgagttcttgatttgattctgagcttgaatgttggtatatagaaatgcaactgatttgtgcattaattttatatcctgaaactttactaaaattgtttattgggtctaggaatcatttggagtaatgtttagggttttctaggtataggattatgttgttagtgaactgatataatttgactaactctgttcctatttggatgctttttatttttttctcttgcctaattgctctggctaccacttccagtactatgtggaataggagtagtgggagtggacatcctcgtgttgttccatttcttagagggaatgttttcagtttttgcccattcagtatgatgctattggctgtgagtttatcatatatggttgttactattttgaggtgtcttccttcaatgcctaattcgttgaaggtttttaatcatgaagtgatgttggattttatcagatgctttttctgtgtctgttgacatgatcatatggtttttgttttttattctgtttatgtggtgaatcacatttattgatttgtgtacgctgaaccatccttgtgtcccaggcataaaaccatttgatcatgatccagttatcatcttgatgtgctgctggattcagtttactagtattttgttgaggatttttacattcatgttcatcagggatattggcctgtagtttttttgttgtgtccttctcagattttggtatcaggatgatactgatttagtagaacgagctagggaagaatccctcatactcaatttttttttttaatagtttcagtaagaggtacagttcttctttgtacatctggtagaacttggctgtgaatccttctggtcctgggcttttttttttggttcgtagatttttaaattactgattcagttttatagctcattattggtctgttcaggatttccatttcttcctggttcattcttaagagtttgtgtgttttgaggaatttattcatgtcttctaggtttctctggtttatgctcatagagatgttatagtagtctctgaggagcttttgtgtttctgtgatatcagttgtaatgccacttttgtcatttctgattgtgcttatttaaatcttctcttttcttggttaatctacctagcagtttaacagttttgtttatcctttgaaataacccactttttgttttgttgctcctttatgtcatatttttggtctcaatatcatttagttctgccctgatctttatttcttttcttcagctagatttgggtttggcttgtttttgcttttctagtttctttagctatgatgttaggttgttaattgagatctttctttttgatgttaagcatttagcactataaatttttgtctttttttttttttttttttttggagacagagtctcactctgtcgcccaggctggatgcagtggcgtgatctcggcttactgcaacctctgcctcccaggctcaagcaattcttctgcctcagcctcttgagtagctgggattacagacacttaccaccatgcctggctaatttttgtatttttagtagagacagggtttcaccatgttgcccaggctggtctcaaactcctgagctcaggcaatcctcccgccttggcctcccaaagtgctgggattacaggcatgagccactgtgcctggcctaaacttaacttagcagtctaaacactgcttttgttgtattctagaggttttggtatgttgtgtctctattttcatttatttcaaaacattttttgatttctgccttaatctcattgtttactgtaaagtcattcgggagcaaattgtttagtttccatgtacttgtgtggttttgagagttcctcttgatgttgatttctaattttattccatgaggtctgagaagatggttgatatgatttttatttttgaaaaatttattgagactagctttatgaccgaacatgtggtcaattttagagaatgttctgtgtgcacatgagaatgagtttagaagtggattcttcctgaatcgggtctccatatgaaaacatagcccaggtgacaccttgcttgcagctttaagagaccctaagcaaggacccagctaagctgtgcttgaattcctgaatcagaaactgtgagatagtaaatgtgtattgttttaggtggctaagtttttgctaatttgttatgcaatagaaaactaatacatcatgaaagtccacttttcctatgttcttgcttgcttatttgcttatttatttgtttagacacagggtctcagttggctaagctggaatgcagtagcagtatcatagctcattgcaatcttaaactcctggtctcaagtgatcctcccacctcagcctccctagtagctgggactataggtgtgtgccactgcacccagctaatttttaatttttttttttttttgagacgaaggcttactcttgtcccccaggctggagtgtgatggcgtgatctcagctcactgccaacctctgcctcccagattcaagcgattctcctgcctcagccccctgagtagctgggattacaggcgcctgccaccatgcccggttaatttttatatttttagtagaggtgtggttttaccatgttggccaggctgatctagaactcctgacttcaggcgatccacctgccttggcctcccaatgtgctgagattacaggcatgagccaccgtgtccggccttaaattttttttaggcagggtctggctatgttgcctaggctggggtgcattcgcgcaatcacagctcactgcagccttgaactgggctcaagcagtactcctaccttagcccccccaagtagctgggactatagacacatgccaccatacccagctaatttttgtattttttgtaaagatgggattttgccatattgcccaagctggtctcaaactcctgagttcaagtgatccaccctgcttggcctcccagagtgctaggattacaggcacgagccaccgcacccaacccagactgtcattttcttgcttttagtttttgtgtattttattgcaatgccactttttttgagagagaggccttgctctgttgcccaggctggagtgtagtggtgtgatcatggctcactgcaacctcagcctcccgggttcaagtgagtcccccacctcagactctcaagtagctgggaccacagggacatgccatcatgcctggctaattttttttaactttattataaataggtgatctccctatgttgctcatcttggtctcatactcctgagctcaagtgatcctcctgccttggcctcccaaagttctgggattgtaggcatgagccagcgcacctggtcacaaagttacttttgttgtagtatctggtacatgaaaacccttttgactaaaatatgtttaatcttttttttttttttttttttgaggcagagtcttgctgtgtcactcaggctggaatgcagtggcaccatctcagctcactgcaacctccacctcccaggttcaagtgttcaagtgattcctctgcctcagtatcccaagtagctgggagtacaggcatgcgccaccgcatctggctaatttttttgtatttttagtagagactggatttcaccatgtttgtcaggctggtctcgaactcctgacttcaagtgatctgcccgtcttggcctcccaaagtgctgggattataggcatgtttaatcttttaaaaaatgaaagagccggctgtgcgcggtggctcacgcctataatctcagcacttttggaggccaaggcgcggatcacgagctcaggagtttgagaccatcctggctaacacagtgaaaccccgtctctactaaaaacacaaaaaattagctgggcatggtggcgggcacctgcagtcccagctacttgggaggctgaggcaggagaatggcgtgaacccaggaggcggagcttgcagtgagctgagatcgcgccactgcactgcagcctgggagacagagcaagactctgtctcaaaaaaaaaaaaatgccaaacttagatttaggatactacccctaacccccatcaaatggtaactggtaagtgtatgtttaagtttctaaaaaattgccacataattttccaaaatgtttatactgttgtactttcctactagggatgtcgagggttccagttggcccacgtccacatcaaaacttgttatgatcagatttgagccattttattgagtgtatactggtatatcattgtggttttgacttacatttcccagatgaataatgatggtgaatatgtttttcctgtccttatttgccatttgtgaatcttttgtgaaatgtgttcagatattttgcttattttgaaaaaaagaataaaaaattactgagttgtacaagttatttatatatttcagatgcagatattttgtcagatatatatagtcatgcaataccatgcaatgttttggtcaacaacagactgcatagacactggtgatcccataagattataaaggagctgaaagtgacatcttgatgatcctgaccctgtgtacacttaggctaaagtgtatgtttgtgtcttcatttttggcaaaaacatttaaaaagaaataataaatttaaaatttaaaaataaaaaacagcctatagcctgcagatgtagagaacaaaaatatttttgtggagcagtacaatatgtgttttaagggtaaagttaaaacttaaagaatttaaggtgaaaatgttacagtaagctaagattaatttattgttaaaaaaataatgtagcctaagtgtacaatgtttatatgttattattatataatgttgtatatattattgttattatataattatattatatgttattttatatgatacaattatataatatataattatataagtttgtaacatataataattatattatatgtttatataatgttattatgcaatattaaatagtgtagcccaagcatacaatgtttctataaagtctacagtagtagacagtaatgtgctagatctttacatttactcaccactcactcagtcacccagagcaagttctagtcatgcaaaccccactcatggtaagtgccctatacaagtgtaccatttctatcttttacatgtatttttactgtaccttttttatgtttaaatgcacaaatacttaccattgtgttacagttgcttacagtattcaatgcagtaacatgctatacaggtttgcggcctggaagcagtctataggctatacaataccatatagcctatgtgtgtggtaggctataccatctaggtttatgcaggtatactccatgatgttcacataatgatgaaatcgcctaacaatgcatttctcagaaggtatctctgttgttaagtgatgcatcactatatatattgtgacttatttttctccagcttgtcttttcctttttggaaggatgtctttcagagagcagaaggtcttaattttgatgttctttgtgagtttttatagttagtactcactcattctgtccaagaaatctgtgcccatcccaagatcatgaagattttctccaatgttttcttctagaagtttgtaattttagcttttatgtttgaatcttaactccttttgaattaatttctttaaagtcttaaaaattatggcaaggtatatataacaaaatttgccattttaacttttttttttttttttgagagagtctcgctcttatcacccaggctgtgcagtggcgtgatctcagctcactgcagcctctgcctcccaaattcaagcaattcttgtgcctcaacttctggcattttaaccatttttaagtatacaatgtaatgacattaactatattcacaatgtcatgcaactgttgtcaccatctatttctaaaacttttccatggtcccaggtagaaactctgtgcccattaagcagtaacacccttcttcccttaccccaggccttggcagtctctgttctactttctttttctatgcatttgcctcttctaaatacttcatatcagtggaatcatatagtattgttcatttgtgtctggcttatgtcacttagcataatgcacatctatattaaagtcagttttggtaagttattttttgaactttttgtctattttaaataagttatagaatgtattggcataaattgttcctgctattctcttattattcttttgctgtctttagatttgttgtgataactcatcttttatttctgatattgatgatttatgttttctctccttttcttcttgatgtctattactgtggttttattaattttattaatattgtcaaagaaccaatttttggttttgttaatttttttattttctgttcctaatttctgctttcttttctttattatattttgaatttaatttacttttaagtttttttaaattgttttttattatactttaagttctgggatacatgtgcagaacgtacaggtttgttacataggtatacacatgccatggtggtttgctgcacccatcaacccataatctacattaggtatttctcccaatgctatccctccctggactttttaaagtttttaatgcagaggtatggattagtgatttcaggtcttccttttttgatataagcatttaaagctatatatgtgcctctaagcactcctttaactgtattccataatttggtgtgtgtgtctttattatagtgtaattcaaaatattttctaattttctttgtcatttcatctttgaccaatagattatttagaaatatgtggtttcgtttccaaatattggaagattttatattttattgtagttgatttctaatttaattctgttgtggttagacagcataatttatggaatttcaatattttgaaatttcttgagactttttttatggcctagcatgtggtctttcttggtgaacatgcaatgtctgcttgattagcttacctgaactctagcccatgcctcctcagcttagtggaactactgtgctctgcttgaactctagctgtctgcccttgtaagaaaattgctcccaggcagctgaggagggagcagcctgacttttgagtttcccttctttctgggttttctttcttgcattacatgtgtcccagtgcctgaaaactattacattgtatattttgtctattcttatggtaatttgtagtagaatggctagttctctttcggtaatgtcatagttacaggtggaagtttgccaatctttaggtccctgcctaaaatcgaaactttttttctttagttctcactgaagacaaagcgtgtactttttacatcaaatgtaaagctataaaattctcatttatttctactttcttgttttcttctttaggtaactcgacagtatgtaaagtttgttgtttaacatgacttttgtccctgttataatctatagaactgaataatatttacttaaaaaagttaggtatctttttctcactttattatcagttaaataaataatttcatttaaggctttatcataggcagtgactgttttatcattttaaaaatcattcttatatgtgcagccattttaacgttacttttcaatatcatttacgttaaacctataaattttccattgttttctgtgactatttttaaaccatcggaggagaggggaatctggctaaatattgtatatataatattatgcttttaagaacaatcacaccatcattctatatcgtctttttttttttttccttctttttggagacagagtctggctctgtcgccaggctggagtgcagtggtgtggtcaattcactgcaacctccccctcctgggttcaagtgattcttctacctcagcctgccaagtggctaggactacaggcatgcgcccccacgcccagctaatttttgtatttttagtagagacgggggttcaccatgttgaccaggatggtcttgatctcttgacctcgtgatccacccacttttgcctcccaaagtgctgggattacaggcgtgagccaccccacctggccctttcttttcttttttgaagacagtctcgctctgtcgaccaggctggagtgcagtggtgccgtctcggctccctgcaacctccgcctcccgggttcaagtgattctcctgcctcagccaggctggtctcgagttcctgggctcaagagatctgcctgcctcggcctcccaaagtgctgggattacaggcatgagccactgtgcccagctacttgtcttttttgaatactctggtttattttctgtgtttccaatcttcagtgatagtaattgtgtaagtactttttgtgtgcagttgttttttttttttttccccaaatttaagcagactagcttatttgtagattttctctttttcctcttctaagctccactgtcttatttttctgtctatgttgggatcacaacgtactcattttcagtgatctgtaggatttaaaaataagacgtagttatatccacagagtacaaagtttgaatatattctcatcaaaaatataaagcgtaaaaaatggaagttttttattcttttaaaagttatttttcttttaaatattcaaaattaatttaaataagctgaattaaaaatttttgtaagtacatatttttataaaaataaattgtaattctagcattaactgttcaaccatttatcagtgtaataaattggttccttgccttacatgtgccatttctagacctgcatataaatacatttactagtaatgtgaattccttaattctgcaaaatgttcctcaattgctgtgtgctactgttaggaatagtgagctaaattatgagtaccttcagaactgtgaattggaacaggaagaaatcaaataaatggatgtttgactctgttaggagacaatactttcttaggaaaggtatctatgatattgatgttatttgacaggaaggatataacagttaatttgtcttgtcttttattctgacaccctgtgctcctcaaatatttcataatctcaggcagagttctctgaagtttgcagtttcacagcccataaatggcgttctgatatagttgcctctcttttaaaggacatgggaagaaatatgtggacaaaggttttcctgtggtctgaactgtacaatttgcaagaatggatttttagggttctgctttgccagtgcagaatcttgtgacagaggaaaccccatttctttaattaatttgttttgtgtgtgtgtgttattttgcaggatctctaaagtgagaagcccatagcagaggcctttcttctggctctacagtcaataaataaatgtgtgaatgaataagagaaggcaggtgtttctttcaccatactgcaaattattgagccctgtcaccagtcccagggaaatgttaggccttcctagtcctggcaaagtcacaggaatattggcacaaatggattctaatgccactaaagaaagtactctgtgtggggatgtgttacctggaggtaaaagtaatatcttctttggtcagataaaggatgtaaaatatggctttcattctctaaaaatcaaacaaatattttctcactttggcattatttaaggagctccgtgttctctctcctccacccaaggagtactgctctgcaatagtactgctcttcaatatatgcagagcaggctagaaagaatccatttgctgctgttgtcagaaatttctactgaaaggtaaagcgcagtgatttatagcattggaaacttgagttagactgctccagtttaccaacttggctgaagacacttctggctagtataattcatatataggtaaccaggtgccaacatattgaggaaatgctacttttctacttaccattggcatgatcttaacttctctgtgtctttaaaaaataataataattttaaaaataataataatggaataatagtacatatatcatatggctatgatgagtactacatgaatattaatgtgtaaaatgcttagaatagaacctaatagttaagcacttaataaatgttggttgctgttatgtcattattattattgttatattattattattattattattattattattattattattattattatgtagcctggtctcgggtattagagaattggagaatattgagtagaaacttaggattcagccataactgcaagccttagctggggatgggaggatagacccaaggttggggcttttggcaactgaccctgatatcatcacaaggctttccaaagtaggagccagtacttgttgagaactgttagatttctaaggtgttctagttatctttaggacctgctactgaactggggattctgaaaaaaagagggtgctgagagggctgaataattggactaatacatggagaggaaaagtgagggcttgtggctactaggtgggtgagtttgcttgggtaattagaacagtggctttcaaactttttagactttgacttcaataacaaataaagtttacattatgacccatcacacacgttcgcatttgtatatttgtatgtatttcagtaatggatgtcataaacacacatttcacaaaacagtgcttacccttgctgtgtgcgaaggactaatattttcttttctattctatttcatttgtatatgtactttttgtgtgcaggtagtttccctttttagaaaatgttgatcctgacttcctaaattgatataatgtcttactaaagaggtgtgacccacatttgaaaaagcactggtttgcctatgagttagtcctttgaacattaccctagaaaaaacagtttgatacgctttgtcatctaggtgaatgagagaagcccctcagagttggcagagccgctgaagcaggggacaagacttgcttctctttggctctcttagctgccagggtttagctccacagtttacttgatcacttggttttcttgagtctaggttctttttctcagatgtcttcctatttgttgggactaatctcttcctttagactgggagattgctccaagagggcaagacttacagtaatagctaacacttttatagtgctttctctgtgctaggcactttgctgtttacatgtattagtcctcaccacaacctatatattaggtaccttaatgatcttcattttacaggtggggaaaccaaagcatacagaagtatgcttagcttacccttcaatagaggtcttctgcaacttaccttaaacattaatggatgaaattaagctagtttctgggcttattttcttaactttccttatggcttttcttaccacaagaatgattagagagtaatagaaattgaacaaaaaatggcactgaactttgtctgaaggagtacagtttagttaagttggtcagattcggcatttgaataatgactgtgctttgagccctaacattaaagccctgtagtcttccttcaggcttgggtttgagaatgaataatgctgcagaaacgcccacatagtcttcgctcattattttaccagtttcttccagtcccttgcccactgcaacagctgtttagcctggcccatgccttctgggttaatagtatttctgacacagtgtgagttttcaagttgctatgtataatttctgccagagtttttactgccgccaggcctcagggttggaggttgcaactgatttgtgggggagggagtttggtgcttgtcactgacgcaggaacaaggtgctttctgtagctctgatttgttgctggctgagtgtgaatgatgtcaggcagatcagaggacagctgattcatttgggatctggaacttgtcactgtcccactgctgcctcgtgggctcttaggtcttttgtggggggatgggaggggtgttctgaagatcatgtttttgaagaaaagtactttaatttttgccgtaagtttgggaagcttttataatttcctttggctgacagaactgcataccccttgtgtgagagaacttcctaccaagactccagtgtgagggcaaaacttgagtagccaggagaatgatgaaacggaggcaagagagactgggagcaccatgtctgcggattcagtaaggaggttggggtctctatggaaactggcagatgtcaggaaaaaaaactaatgccaactaacacagcttcgttcatttggatgaagactgttttggagatgcctgtcaggaagagggctgagctggcttgattaattcaaggtcaaaacagtggtccttggcaggggcatatgaggtttccaattccagaaactgaattagatgtcattttaggggttcctgaatacttggagaactgggtaaaaaaatgaagacaattattttcttcccttgaaagcaaatgtttatttaaagttagtgtcaaggctgcaaatacaaaccccgtgaatgtgagaaaccaatggaaacaaaaagtacctcctcctttgactagagagggtattgtatttctgcccatggcctgtcagctcaggacctcagatctgcccttgcagattcaagcatgggtcctttagggtgtgacctctattttatttctatattggccaatatagaaataaactttattaggtgagaatatcaaagctgggagtggaagaaggcttcctcttcagggtgacttttccaagagcagctcaggcttatttaatgaagaagtgccaagtgaattcatcagtaaattagagaaccagtgaaagaagagacctagaattcatttcacctcaattatctgtcttgaactgcctttgtttaacccacagggctaagggagtgtacttcagattttcttcctgagtcaaactgcttgccctgagacagacaggcttcttcagtgggcttcctttgtgatgttgcccttcagtgtctgtggatgcttattgattgaattaatgattctattagaccttaagaaacaggatttgtttgaagtatatagttgtagtattgacacactttaaaaaaaaccttttattaccatactgacacagaagtaaaagaccatttaaaaacagacttcatcaactaatgtgttatttaaagtaaaggtcacttgttaacaaaattaaaaatttttaaatggagtttgtagcttaagaaaacttaaatggtcaaaaatcatggttctgtttttgtttttgagagtgtcttactttatggcccaggcgggagggcagtggtgctatcacagctcactaaaccttgacctcctgggcccaagggatccttccacctcagcagctgggaccacaggcatgcaccaccaagcctggctaattttttaatttttttgtagaaataaggtctctctatgttgctcaggctggtctggaactcctgagctcaagtgatcctcttgcctcagcctcttagagtgctgagattaccatacctggcaaatcatgctcttcaaatgtgggtacactgctgttggtaatcattttctctgttttactgactttgagttagaaaaataccccctgaggagctaataagtagtttgtatatcaccttttcctgtttcaaacaatcctttttagactctagacccattgtataaccagtttgcagagtagtaattaggggcaaaaagaaaatgaaatttgccggccaggcgcggtggcttacgccagtaatcccagcactttgggaggccgaggcgggcggatcacgaggtcaggagatcgagaccatcctggctaacacggtgaaactctgtctctactgaaaatacaaaaaattagccggacgtggtggcgggcgcctgtaatcccagctactcgggaggctgaggcaggagaatggcgtgaacctgggaggcggaacttgcagtgagccgagatggcgccactgtactccagcctgggtgacagagtgagactctgtctcaaaaaaaaaaaaaaaggaaagaaaatgaagtttggctttcatagatttttataatttcaattatatattgaacaaaatgtctaaacctcattttatgtgataagacttaaggcttcaaaattttgtacaagcatattattcaggttaacaagtaagtgctgtctaatgttctaattagttctaacatatatatgaaggagcttaactttgaaatagttctttggaagagtgaaaattctttttgaaaatgagaaattaacttaaaattaacatttttacttcttttaactttaaaaaaatgttgagtttgtggaaatgtgggcataactgtaattttaaatagttgtgtgccctcctattttctatcctgttactaccccatattgtgtacccacctgagaagtaaactgaagaccactagagtgataatgactaggaaagtgaagatttcctttgaatatatgtaagcaagcacaagtagaatgtcactgtatccatattataaacagtcagaaataacaatacgagaaactaacaatgttatcattttgaattagatcaggtacttatgtgatacttaagtaatttttttaccttggaaattaaataatggtgtgtgtatagaaagccatgccaataaggtagcaaattaaatattatgaatattatttttatcatgtgtcgtttctactaatggtagcaaattagaaatctatttattacctgttttcaatctaatgatcttatttatttaataatcttcgataggacttaacatatcaaaatggctagattgtttttatgggaaaaaataacctgggaatctaaaatttaagtagaagcaaaatacatagttaactgacattatatgatacattcattagagaaatgttagctaaacaaattggtattattgttgatataatcaataatttataaactattcagaatgttttactcttagggacatatacatttctttaggaagttttagtcattgaatattaaatattaactgttgcctgctaattgatgtagtaaatttgcagtgtttggtttgcccagaaaccaattctaaatacttcaggctgggcacggtggcttacatctgtaatcccagcacttttaggaggccgaggcgggtggatcactcgaggtcaggagttcgagaccagactgaccaacatgatgaaaccctgtttgtactaaaaatacaaaattagctgggtgtggtggtgcatgcctgtaatcccagctacttgggaggctgaggcaggagaatcgcttgaacccaggaggcagaggttgcagtgagccaagatcgtgccattgcactctagcctgggcaacaagagcaaaactctgtctcaaaaaataaaaataaaaataaataacaaatatgttgaatagccaaatcttaaatgttgtattttaattttatggattaagtttttgtctctgttgtcatcctgtaccaacattggtactgaagtatgatattggagaatgatttttgaccacttacttttcttgagctttttgcctaaaccaagccactttgaatatgtttctttttggttgaaaagttatcactgaccttgtttttttcctattgtggtaccttgtcagaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggaggtaaggaaacttgctgtgaatctgggccttgacaattgcttctggccaaatggtaaaacgcataccttactccttaataatggggagaaatggagtaagagtcttggttctgtcacagagaagagtaaaataaatatcacagatttctgttgtattcaaaatgtcaggagaaaggagggtaggttatcagtacttggatttttgaggctattataagttgtgtgcccatcctgaccattggacagccttgtgaactatgacctgtgaccaccccatagcatggcagagtgctagaactcttaggaggtaaaaaagttcaaacctcacattttacacgatgggaaaatttgagtccaaaacaagttaaatggtttgttcaggttgaggaaaatagcccttctcccatttctttctgtcttccttttcttatattcaacattatttgattacgtactatctgctaggacactgttttgggcatgggaaacaaagcagtgaacataaagcaataaaatccctgtcctcagggagcttagattctagtggagaaagagagacaagttaatgagtaaatatgtaacataacggatagacagtgcttctgagaaaaataaagtaggataagagaatgtagaggccagggcttgacattttatataaggtggtcaggtaggtcctcagtggtaagttgacataaaagacctgaaggaagtcatagagcctgaatggagatatctggaagaagagtgttccaggtggaggcaacatgaagtgccaggggcctgatctaggagcttgctccatgtattctttgtgcaacagagtccagtgatactggtacagaataagttaggtggtgagtattgggaaatgaggcctgaagtgtagtgggcagccagattaaacaattttgaggctttttgagatagagtttcgctcttgtcacccaggctggagtgcaatggcacaatctctcctcactgcaactctgcctcccaggtttaagtgattcttctgcctcagcctcccgagtagctgggattacaggcggctgcccccacacccagctaatgtttgtatttttggtagagacagggtttcaccatattgaccaggctgatctcagactcctgacctcaggttatccacccgcctcggcctcccaaagcactgggattacaggcatgagccaccactactggccaggacttttgtttttatgctgggtgagataagtagccactggaaggtttaaataagaatgacatgatctgacgtagatcaaaagatcacgctgggctgggcgcagtggcttacacctgtaatcccagcagtttgggaggccgaggtgagcggattgcttgagttcaagaccactcacaagttcgagaccagcctgggcaacatggtgaaaccccatctctacaaaaaatacaaaaattagctgggcatggtggcgcgtacctgtaatccctgctactctggcggctgaggtgggaggatggcttgagcctgggaggtggaggttgcagtgagctgagatcataccactgcactccagccttggagccagaccttgtcaaaaaaacaaaaactaacaaaaaaacacactctggttatagttagaaggccactaggtaagagacaatggttatttgaacccatgatgattcagataagaagtggtcagatttggggattattttaaaggtagaattgatagaggaggaagagatatccaaggattgagctctggggcaagttttagaggttggggcgatagtgaggaattagactaaaatgaattagctattcattcaggaacaaggactaggagaagtatcttagaagccagttgaaaaaaaaatgttaaaaaaggaaagcgtgattgatcagtaggtatttgttaagctttttgttagagaatagtaacctgaaaaactaaaagtttaagtgaaacacaatgtatcacacagatttaagtgacattatttgatacaggagcttaaattccacagacagtttgggacagtgatagactgacataggacaatgttagaggctaacttctctctgaaggcacctcttctagacgtactagcgcttggcgtatgaggctgagaaagattgtaagttgggtagcccccaagatgtacccagtcctggcacatggttttgagtatctcttgatgactatggtctcagaacacacaacctggagcaacatcttacagctttggagcttgttaaatttcatgtttttttttttttttttcatagacttactaacatgtgtggtcactgtattagtgcttcattccattcttcttttgtatccatgccatgcaaagtgccagttcattgatatgacaagattattttagcttgttgtttgctagatatttttatattcctttaaacattcttgagaatctgggatgcagttatttagaaattgtttgatcctttgaaggaatactttcaggctttgtttggtgagaccagggcagcacttgaggctaattttttcttactactgaggcaatactttgagtactctatttgatgcccatgtattgtgagttttttccactcaggctgatgggagcatgaacgattctgggtccttagtgagccctgaagagggtacctgctcatgttcttggatagtttccttatccacatatgctgatagatattcagctaaaaactcagaggaagcccctgcagatctccagagttcccctctgtatatctgtcttctctggtaccctgctttgaaaattctagccaccttagcctccccaagttctcaactctgtcttctcaactcagggagactgctggactctgtttgagtacccccttttgctgcttcctaggcatgcagtcttagggcttattttgcatgtttcccatcggtccagtgtctgcaaactattgtttcatatatttcatctaatttttttgtttttaaggtgcaagggtaaatctgatctctgattccccataatgatgagaagcagaagtctagtcttgctaatattttgagctcatgcttctgtcattagttgttcttattgctttatgagattattggttgactgattcacgttgcataagcccaatagaagcagattattttaaaattattttatcttccttagtcaagaaaagttggaaaatgtaatgtcaaaagaataagaataggtaacatttgctgagcatttactatgtcttaacatttttaaaatgacttacatttgttaaatttaattctcaaaatactctgatgaggtgggtgacacatgttcatttttttttcgatgaggtggataatctgagtaaatctgttttatagatgaagacactgtagtacagagaagttaaggaagttattaataagtagtagaaactaccattcaaccccacagtatcttactccaatgtctgtggtgttttttgtttgtttgtttgtttgagacggagtctcactctgtcacccaggctggagtgcagtggcgcaatctcggctcactgcaagctccatctcccgggttcaagcagttctcctgcctcagcctcctgagtagctaggattacaggcgaccgccaccacgcccagctaatttttgtatttttagtagagacggggtttcaccacgttggtcaggctggtctcaaacccctgacctcgtgattcacccacctcggactcccaaagtgctgggattacaggtgtgagccaccgtgcccagcctatgtctgtggtcttaacccctcagctgttgttacgggatcctgggaggtgttgcttttctagctagaaacctctgtggctggtgacgcttttgcctgagctttgtttgctcaggcctgctgggcccagttggcccagcaggctgcacttgcctcaagctaccagcctggatcccatgcctccaaagagactggagcggaatagtgaagggtgtgtggcaagtgagcatagggtccggccactgcacgcagtcaggcatgccaactgctgcagcagggcagctagctccaagggctggcatgggtgctagctcactgtgaggctgcatcgggaccaggcgccacgcaagcaacttccacagctggcacaagggaacgcggtggtgcccagaaacttggagactttaggagccaccaggccccaaagcaggagtcacagctcaggctcggggagctctcaggtctggtctctccaaagggctgcagctcttctctccttctctcttctctccttcttgtcgcccacaatgtgttgagcaaggggcatgtttcagctctgtttgtattacagctcttttggccctgccattcggtgggtcccgagttcttgtcctgcatccaaaaggaatgaggtacacagacaaatatagggtgagcaagacaaaggggaactttattgagtgatataatagcttagaggggacccgcagtgggtagctcctatctgtaggcaggtcctcccgttgagtgttcagctctcagcagagaggaggtcctggagtgggtggctcctttctgcaggcaggtggtcccattatctccctatggtccctccctcctctccccaagcctggctgagtccaggggcttttatgggcctcagaggggaggaagtgcatgctggttggtccatgggcggccatgggtgggcccagggaaaagcaccacaagttgcccttgcggtttctgggactggcgacccatcccccaggcttcaggctttccctggcttggaggtgggtcttcactgtggaccagcttctctccacccaggagcctgtctgcctcctgctgctgttcatggtgaccaggctgttcatgctaaggggtgcctgcaggccagcactgggctgtcctcagtgcacccctcagcctccttcccatgcttgtcagtgcccaaagcctggagggggccaaagtggcaagggggttggcatgtcagcactaccccgagcatgtgcacactcagctgggctgtgacagctcccgggctgggtcccaactttgctccgaggttggagtaggcactgacagaggggagaagccaggtagcgggagcggacgattctgagcctgcgaggggcaggggccttcctaggcccgagagttcagagatgcctgggtctgaagctgcagcagggcggtggtggctgcacctggggggctcccaccccaccaactcggaaggggtggggctcccacttttccctggctcccaccgactctgtagagcatgcagccccagctccatctcctagcagtcttgggcaagggctccaggtctgatgcattgtcctgggccaggtgctgggctgctccaacgcatcgagtctggtgctcctggtggtgaccgtgccagttgtttacatggtgatctgctccatggggctggtgaacaatgtgggcatgctgtacttgctgctgtggggtgccgctttcacttcctaccctgggcccctgaagcatggccccagctctgtgtctcgggccagacctctgtgccccatgtgcaagcacgggaccaccctgggcccagctctgccctagtgcccctctctgcctgttcctctgtgcacttctctcccactggcggacggctcagctcagcctggcccaattgtggcagttcccaggggtgggttcccagggcagtgggcctgtaggggggcttccaaaggagggttccagggactgtccaccttggcgtctgcaccggaagacccgtgtcctgcatctgtaccccactgcagccggcgtcatggcagtgactgcttcatggcagtgacgggctgccactgccatcactgtaatgtttctgatgaaccatatgcaatcgagaatttatttaataaatttacaaactctgagcacttactagctcccaggcactgttcttagcactttaaaatgtaaaggtcatttgcttctcacaccagttctgtgagagagattatcattgtacttatttcacacaggaagcgagggtgcagagagattaaataaattgctcaggataacacagctgtataagtggcagaactgggatagaaacctgggtagtctggcttcagagatcacattcttaacaaccacactgttccatgtctccatctgagatattttcattatgtaatatcatacgttctgaaccaaagtagtttttgcagccttgggtcttttcccaaggtgatgtattaataacattgtttaataaatcctccaatcctgggggtgggaattggtattcccacagtctgttgtcacttctaggtcattacctttattaccttcttgtaaaaacctctgttcttttttttgagacaagttctcactctgtcacctaggctggagtgcagtagcatgatctcggcttactgcaacctctgcttcccagtttcaagcaattctcctgcctcagcctccccagtagctgggattacagacacccgccaccacacctggctaatttttgtatttttagtagagactgggtttcatcatgttggcaaggctggtctcaaactcctgacaagtgacctgcccacttcagcctcccaaagtgctgggattacaggcatgagccaccacactcggcaaaaaaatccctctgtttttttaggcctgtatcattccattttacccctgctcattactgtcatctattaatttagttttgttctctgtactcaaattcacagtccagaacagaatctgtgcttagtgaaaacggtgatgaacctccattctgcaacatctttatgatgaacctctcttactcaatttattaagcaaattagcaagtaaagtagaaagatgagaaaaatggttccagtaaacaatgtgcataagtgaagaactgaaaattgagtgctactggcagtgaatttgactctgagttccagaagagagggaactaggaggggggacttccaggggcgggttccagggactgcccaccttggcatctgcacctgaggacccgtagcctgctcctgtaccccactgcagccagagtcatgtcagtggccatattaggatgtcttttttatctctctttttttaatttgatgagtataactattataggctgaattatgttctactaaaatttgtataggttgaagtcctaacccctagtaactcagaacgtcactgtatttggagacaggatctttaaaggggcaattaaggttaaatgaagtctttgagatagatcctaatccagtatgacttgtgtccttacgagaagaggggattaggacacagacaagcacagagggaaggccatgcaaagacaaagggaggtagccatttagaatccaaggaatgaggtcatagaagaaaccaaccctgctaatgcccttatcttggacttctagcctgaactatgaggaaataaatttctgttggttaagtcacccagtttgtgatacttggttatgtatggcaaccctagtaaaccaacacagctattgaggcatttggctgcattgccccagagttggaaaacagtgtccccttgcatcatagtgtagtgaggactagccctgcttaaggtcttaagcctctttattgactgtatcttagggatggtcttaggaccttacaaattgttgcccgtaataatttgaaggacaatgaagatacagtcttgaaatgatacccactctagctctgtaatacattgcgttttatgccttgattggaaggaatgagtctgttataaacaaacgttgatgctagctcttaagtgtctcagatgggtatgatgaaccttaagaggcataataaatttcattgtgatttgggttaaattaaataaccactaacctttactccatttgcatgtcttctaagaaaatgattccagagtattgattggcactcagatgggggtgttgcatttttagagtaagagtgctagattgactttgtgttgtaagtggtgtccttgaagagaggaggcagttgtgtctctggctattcactggcccagctgtaggcctgctggagagagaagtttgatgttaacagcttaatggaacacagaatgacttaggttttgaatcagttttgaattgccatagactttgtcagccctgaagtaggagggcttgcagcaggaaatccttactagagtgatttttatattggaagcattctagctttatcttgcttcctactgcataggaatttcttccatacaatgtctagcaaaaagctattcagcctttgcttgaacatcttcagcaacaagcagttcactctcaaagctttcatccagtggtaccaatttagttctctggcacctcctatgtcacacgtatgagagacttttggtagacttgcgtggcaaatggacaggtgttcctttgggcctcctccagaactaggcaacctttgaaacccctttttggtagtgtcaaaattatttcctgccaaagagaaagcactattttcattttaccaacacctgcttttcttgtcttgtctttttttaaacaactgcttttcagagtaatttcaaaagaggaacatctcccagaacttgttcttatcctggccctgctgcatagtggtggtaggcagattacttcacttctttctacctcagttctcttcattattaaaatgggactcacaatagtatttcaaggattatagtaagaattaagtgagtcagtacatctacaattgtttagatattacctgggctgctagactggttattttgctgcttccattgttgggagactcagatgttgctaattcttagcacttcattttgcttccattacttttttctttgcttctattacttttctcatattcttattttcccttggatatattgcctaccatatgtccatactgcagaagctccattactggcttaggtgaggcagtggcagctgggtgccctcctgccctctcatgcattctcactaattgtttctgctgaaaactggcctgttggggctcagcaggacatggactgaaatgaaaaacactttgaattacattctttctaaaagaccattttttggcaatgaggaaagtccatcaaaacggtttcaaggtatttcatttctcctcttacagcagggaaagcgcatcttgagagtatcttcagaagaagtgattctcttgttagagtagggaaggttttttgattttttttttttgttttttcattgaaaaggtaaaataatgaagactagtgctgtgctttaacttcaggaacccttatatgcgacagatagtttttcatagaccctggctccaggtgaccctgaatgaagatataatcctgtatggctagatgccaaatggttgctcttgcctatcaggggacctgtcccgataatcatgtaggttcttttatatttttcctaagcgtcggctggcttgagaaataaagggacagagtacaaaagagagaaattttaaagctgggtgtccgggggagacatcacacgttggtaggatccgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggaccgaggcgaaattaaaattgctaatgaaatttcgggcactattgtcattgataacatcttatcaggagatagagttttgagatcaaccggtctgaccacaatttattaggcgggaatttcctcttcctaataagcctgggagcgctatgggagactggggtctatttcacccctgcagcctcaaccataagagacaggccacgcccaggggggctgtttataagccaatacctccaggcgcgtattctctttctcagggacgttccatgctgagaataagaattcagcgatatttctcccatttgcttttgaaagaagagaaatacggctctgttctgcctgactcaccggcggtcagagtttaaggttctctctcttattccctgaacaattgctgttatcctgttcttttttcaaggtgctcagatttcatattgctcaaacacatgctgtataatttgtgcagttaacacagttatcacatggtcctgaagcgacatgcatccttttcagctgacaggattaagagattaaagtataaagacaggcataggaaagcacaggggtattgattggggaagtgataagtgtccatgaaatctttacaatttatgtttagagattgcagtaaagacaggcataagaaattacaaaagtattaatttggggaactaataaatgtccataaaatcttcacaatccatgttcttctgccatggcttcagccggtccctctgtttggggtccctgacttcctgcaatacttgcctaagagcaggaagctgaagctttctaggatacttctgtttctagaactaggaaaattttatttactaaattttacattgtgttatggaaaaatctcaaaaatgttcaaaagtagaaagactcatactacatccccagtatcgtctacattgtcagctcatggtatactatctcatctacatccccacctattttctttctctgtctctcttgcttattttgaagcaaatctcaaattttatgtcatttcatctatacatatttgtatctctaaatgtaaggactcctgaaaaatgtaatcacagtattattaccacacctaaaacaatagtttatcaatgtaatcaaatatccagtttatgttcaaattttttttgcagttggttttttggaatcagtagccaaactatgtcagcacagtgtatttggttaatacatctcttaagtagggtggtgatacaatttagtgtctaaactaggaaattttatataatgaaagaggattgttaatattactgggacaacagacataaacctgttaaataaaataattgggatgtctgatcactctttctttttttttttttcttttctttttttccttttgagacagagtctctctctattgcccaggctggagtgcagtggcacaatcacagctcactgcaaccttgaactccaggctcaaacaatcctccaacctcagcctcccaagtagttgggactacagacatgcaccagaagcctggctaattttttctattttttgtagagatagggtcttgccgtgttgcccaggctgtactgcaaagtttattttaatctagggtgttctcacctttttttttttccttgcaatttatttgttgcagaaaccgagttgtttgttcttgtagactttcccacattctggattttgctgattgcatccttcagaggtttttttctgacatgttcttatgagctctgtatttcctataaactgggggcttgacctgattgtggtttggttgggttgagggggtgggaagaatacttaacagttggttcagtgtatatctgtcaggaggcgggtaatgtcaagtctctcccttgttttgttagtagtggccattgataattatcacctagattcattattttcttaggagtttgcaaaagatgattctccttccctttattaactacagtacttacacaaaagaattttctcctcattatctgtttttttttaccctgaagtacagataattacccttattcgcattgactcagcttagactctttcctgagtcttcagcctaaagcctgagtgtcctcagttccttggtcagtgtttcatacctgcttattactgcttcgttgtgaagattgtttgcccagagcagcagggggggagttgttggtggtgaagccccttggagtttgccatttacatagctaactgattgctcagctgaggaaaaccttggcttcctcttctggcccacgtagaaagaggaattatctgtagtagtcatgcttgttatgtagactctgggactctgagaggtgagaatgcatctagaaggcagcagcttttctttcatgtccctagatgccacaagaggaggagccattgctgatcctgatggcctcattttggtagataggatgggcttagggctagagagtcctgctgttaagaaactagcatactggagtagtcagagaaacgattaatttacaataatagatccttgacacagaagaattaattttcatggctttgtttgttaatatatacatatgtgtgtgtaaatagatggatttttttttttggagggctatcttcaggataaattactagaactgggatagctgagtcaaaaattaaatgtatatgtagttttattagatattgtccagtttcccttcacagtctatggttatactattttacatttccatcagcagtttaagataatgtctatttgcacacagccttgccaacaatatgattgtcaagcttttgaatttttgctaatctgagagctaaaaaatggtatctcaatgtagccaagtaaaaagtcatattaaaatattcctaaaggatgaagtttgttttgaggggggatggaatttctctgtcgcccaggctggagtgcgcgatctcagctcactgcatcctccgcctccaggtttaagcaattctctgcctcagtctccccagtagctgagattacaggcacccaccaccacgcctggctaattttttttgtatttttagtagagacggggtttcaccatcttggccaggctgatcttgaactcctgacctcatgatctacccgccttggcctcccaaagtgctgggattacagatgtgagccaccgcgcctggcctgttttttgttttttttgttttgttttgttttgttttgttttgttttgtttatcttatgtgaagggaatcagtttcctgtcctgggaaattgagatagatgcattcattcattcattcattcatacattcaactgcatactaggccctctgagcaggagaagatgcccacataggcaatagaacacttcgcagcacggggtagagtaaaagggatgctttttatttcataagctttcagccttattcacccctattcagtcattcccagaacttttcaagtgatttctctggatgttagcagaaatatttttttaatgtcaaaattccaagaatagttcaaagagcttttcaccccccaaaccaggggtcagcaaaataaaccccatgaaccaaatgtgacctgtgggctgtgtttatacaagccacaagctaataatgaagtttacattttttaagggatatttacaaaaaacaaggaatatgtgacagagaccacatgtgacctgcaaagcctaaaatacttattatctggcctttacagaaaaagtttgacagcccttgtcctaacccatactgaattagctcctgatatgttatctcatcagccctgaacactttagtgtatacttcctacagagacattttcataacagtacagccattaaaatcagaaaattaacattaataaatattaccatctaatctacaagtttaattcatatttcaccaaatgtcccagtaatatcctttgtaacagaaggctccgatccaggatcatgtgttagaattttactgttattcgtcttctatctcctttaatctgatgcagttttgtagttatttcctcaacttttataacctcaatacttttgaagattacagaccagtttatttgataggatgtcctttaatttgaatttgtctgttatttcctcaggattagaatcaggttatgaacctttggcagaaatatcacaaaaaggtggtattgtgttctgttttttttttttttttttttttgagatagagtcttgctctgttgcccaggctggaatgcagtggcacagtcactacctcctgggctcaagtgatcttcccaccccagcctcttttgttgtttttgtttttttgagagtgtctcgctctgtcacccaggctggagtgcagtggcatgatctgggctcactgcaacctccacctcccgggttcaagcgattctcctgtctcagcatcctgagtagctgggactacaggcgcccgccaccacacctggctaatttttgtgtttttttttagtagagacaggacttcaccatattggtgaaactagtctcgaactcctgacctcaggtgatccgcccacctcagcctcccaaagtgctgggattacaggtgtgagccaccatgcccagtcccaccccagcctcttgaggagagtagctggaaatacaggcatacactaccatgcctggctaagttttaaaaaatttttttagagacagggtcttgctgtgttgcctaggctggtcttgaactcctgggttcaggtaatcctcctgcctcggcctcccaaagggctgggattacaggcgtgagctactgcacccagcaatgttgtgttcttctcattgtgtcctgttaggtgatacaggctttcgttttgtcccattactatgaagttaaccttgatcactttattaacgtggtgttttgctgctgtaaagttttgctgctgtgaagttactctttttttccctttgtaattaataagtattttatgggaatgttcttaaaattatgtaagtaccccattcctcatcaaattttaaccctctgtttttaggatccattgatgttcctggttgcattattatactatgctggtcaccaaatggtatttttacaatttcataattctttctatacccatcagttggcatttcaccatagcaaaagctttcacctctccctattcatttttcacttactttattatactgtataaattcagtggacttttgactgggcgctgtggctcacacctgtaatcccagcactttgaggtgggtggatcacttgaggtcaggagttcaagaccagcctggccaacgtggtgaaaccctgtctgtactaaaaatgcaaaactagccaggcgtggtggctcacgcctgtaatcccagctacatgggaggctgaggcacgagaatcgcttgaacccaggaggcggaggttgtagtgagccaagatcgcaccactgcactctggcctgggagacagagtgagactctgtctttcaactgccccctccccactccaaaaaaaatttagtggatttgtcttatttgatgggttatataatctgttaataccattttagttttgatgctcaaaattgtatcatatctggtcaagggaagtttcttcaggctgacttttgtgtctttttgatgtctctgtcattctttgagaactacgtaactttctgccctgagaagatattcctggctggcttattttgtaccctcactagcccttgagctttttctctaggcagcatagttctttttagtggagaatgctttttaaaagccaaaatatgaatcaggcatggtataatcccagcactttagggggctgaggagttcaagaccagcctgagcaacttagtgagaccccatttctttaaaaaaaaaaaaaaaaaaaaaaaaaggccaagtgtggtggcacatgcctgtagtcccagctactcaggaggatcatttaagcccaggagttcaaggttgcagtgagttatgatcacatcactgtactccagcctgggcaacagagcaagaccctgtctctttaaaaaaaaaaagcgggggggttggggggggcaaatgttgatggtagacatggttgcccatacttaggttcactgctcccgggaaatgtatacatgtaacacacatgtatttatttcttaatttctgttattgaaaactataagctcacactgatacctccacttctaattctagtttggttctagtttttgtttttatatttgtaacttccttctttgaaagtgagaactctggccgggcacggtggctcacgcctttaatcctagcactttgggaagccaaggcaggtaggtcatctgaggtcaggagtttgagaccagcctggctgacatggtgaaaacccgtctctactaaaaatgcaaaaaaaaaaaaaaaaaaattagctgggcatggtggtgggcacctgtaatcccagctactcgggaggctgaggcaggagaattgcttgaacctgggaggcggaggttgcagtgagccaagatcgtgccattgcactctagcctgggcaacaagagcaaaaactcagtctcaaaaaaaaagagaaagtgagaactctgaccccccattacccttgatatatttacttatttttttctagtctctaattactagtttattttcctcaatttgttttagtaaacaaaatattgtatccttctactttaatgaaaaattttaagtttttttttttttccccaactttagctttagggtcagggggtattgtgcagatatgttacatgggtaaattgtgtgttgtggggatttggtgtacagattattttgtcactcatgtaatgaacgtagtgcccaataggtagtttttcagttctctccctcctcccaccctccaccctgatgtaggccttggtgtctattattcccttccttgtgtccatgtatattcagtgtttagctcccacttataggtgagaacatggagtaattggttttctgttcctgcattaattcacttaggatggtggcctctagctgcatccatgttgctgtaaagaacataatttccggtgggcggatcatgaggtcaggagatcgagaccaccctagctaacacggtgaaaccccgtctctactaaaaattacaaaaaaattagccgggcttggtggcaggtgcctgtatttccagctactcgggaggctgaggcaggagaatggcctgaacccaggacgcagagcttgcagtgagctgagattgtgccactgcactccagctctgttgcctaggcttgagtgcagtggcatgatctcagctcactgcaacccctgccttctgggttcaagtgattctcatgcttcagcttcccaagtagctgggatcacaggtgtgtgccaccacacccgactactttttgtattttagtagagaagaggtttcaccatgttggccaggctggtctcaaactctgcctcaagtgatccacctgtcttggcctaccaaagtgctgggattacaggagtgagcaactgtgcccggccaatttcattctttttaatggctctgtagtattctgtggtatgtgtatatgtaccatattttctttattcagtcctctgttgatgggcacctaatttgattccgtgtctttgctatagtgaatagtgctgtgatgaacatgtgagtgcatatgtctttttgatagaacgacttattttcctttgggcatatttccaatgatggggttgctgggttgaaaggtaattctacttttagttctttgagaaatctccaaactgctttccacagaggctgaactaatttacaattccaccaataatgtacaagaatttccttttgtctgcagtctcgccagcatccattattttttggctttttattaataaccattctggttagtgtaaaatggtatctccttgtggttttgatttgcatttctcagatgattagcgatgtggagcatgttgtcgtgtttgttggctgcttgtgtgtcttctgaggagtgtctgttcatgtcttttgcctattttttaatggggttatttgttttttgcttgttcagttaaggttttttgtagattctggatattagacctttgtcagatgtatattttgcaaatattttctcccattctctaggttgtctgtttactctgttgataatttattttgctgtgcagaagctctttagtctaattaggtcccatttgtcaatttttgtttctgttgcaattgcttttggtgtcttcatcatgaagtcttccagggcctatgtccagagtggtatattttagggtttctactagggttgttatagttttaggttttacctgtaagcctttgatcatcttgagttgatttttgtatatggtgaaaggaaggggtctagtttcaacattctgcatacggctagccagttatcccagcaccatttattgaatagggattcctttttgcattgcttttgtccactttgtcaaagatcagaaggttgtagatgtgtggctttgtttctggattctctaaccttttctattggtctgtttgtctggttttgtaccagtactatgctgttttggttactgtagccttgtggtatagtttgaaattaggtagtataatgcctctggaattgttctttttgcttctgcttcagattgccttggctatttgggctcttttttggtcccatatgatttttagaatagttttctctaactctgtgaaaaacgtcgttggtagtttgagaggaataacattgaatctgtaaattgctttgggctgtatggccattttaacaatattaattcttcctatctgtgagcatggcatagtttcccatttgtttgtgtcatttctgacttctttcagcagtgttttttaattcttgttgtagagatctttcacctccctctttagccatattcttaggtattttattcgttatgtggttattgtcattgggatttcattctggatttgaccctcagcttggacgtcattggagtgtagaatcactactgatttttgtatgttgattttgtatcctgaaactttgctgaagtttatcagatctaggaacctttgggcagaggctgtggggttttctaggtatatagaatggtaattgtctgtgaagagagagagtttgccttttgtttctttctcttgcctaattgctctggctaggacttcctatgtggaataggagtggtgagagtgggcattcttgttttgttccagttctcaaggggaccgtgttttttgcccagcatgatgttacctgcaggtttgtcatagacggctcttattattttgaggtatgttcctttgatgcttagtttgttgaggtacttgattgtctgatcattttttcctctgtgtaactaatctccttttgtaaccaccagccttctgtgtgtatgcccttctcacttcactgggtctccaataccccatgaaagactggcaccactgttctcttcaagcagacaacttccttatccccatcagtctctgacatcccaggccaggtacctcaaccccaacccagccacatggccaccatcatcatcatcatcttgtggcctctagactgaattattcaggaaagaaggagaggaaggaggattctaaagccccctaagtacctcagattcagtctcaggggcctgcacattttgaaacatctgacttgagtttttttaagtttctttattttttagagatgagtcctctctttgttgtccaggctggcctcaaactcctaggctcaagcagtccttccacctggcctcctgagtagctggatctaaaggcattataccaccatgcctgggcttttttttttttttctccagtcacttttgtttttatttattctaatattatttgtttgtttatttattttctttctagaaatgagatctcactacgttgcccagggtgatcctaaacccctgggctcaagtgatccttccacttcagcctcctgagtagctgagactaaaggcatgcaccaccatgggcagcttttttttttaattacagtcacttttattttcattttaaaattttatttatttacttgcttgttcattactttttttttctagaaatgggatctctctgttgctcaggctgatctcaaactcctgggcccaagcgatcctcccacctcagcttcccaagtagcaaggactacaggagtgtgccaccatgcctggctgagacaaaatttacaaagtataaaatatgcccattgtggttgggtacggtggcttacgcctgtaatcctagcactttgggaggccgaggcaggtggatcacctcaggtcaggggttcgagaccagcctggccaacgtggtgaagccccgtctctactaaaaatacaaaaaaattagccgggtgtagtgtcgcgtgcctgtaatcccagctacttgggaggctgagtcaggaaaatcacttgaacccgggaggtggaggttgcagtgagccgagatcacaccactgtactccagcctgggagacagagtgaaactccatctcaaaaaaaaaaaaaaaaaaaaaaaaaaaaaaattacccattgtaagcaattcaacgtaagcgattcaatggttttttactaaatttaattgcctattgtaatctcttcagtgtaagggattcaatggtttttactaaatttatataattatgtattgtcaccataatccaaatttagaacacttctgtcactcagaaagtttacttgtacccacctgtagttaatcctactcttctaattcctagctctaagcaataactcatctgctttttggttctgtattatgtgctgctaaatgtagttttttgtttctggtttctttcacttaacataatgtttttgaactttatacatgtagcatattcattcctttctattgttgaataatgttttattattggatagaccatattttgttagtccattcaccagttgatggacatttatattgtttgcagtttgggagtatcacattaatggtgctgtgtacatttccatgcatatctttgtgtggacatatgtttttatttcttttgggagtcagagaattgtgttgtatggtaagtttatgtttacttttcttttttcttggagatggagtctcactctgtcatccaggttggagtgtggtggtgtgatcatggctcattgcagcctcaatctcctgggctcagggaatcctcctgcctcagcctcccaagtgactgggaccacaggtgcacaccaccatacccagctaattattatttttttatttgtagagatgaggtctcaccatgttgcctacactggtcttgaactcctgggctcaagtgattctcctgtcttggcctcccaaagtgccaagattacaggtgtcagccactgcgcccaaactatgtttacctttttaaaaaacaccaaactgttttctgcagtggactgcatcatttcacattcacagagtttattttttaacattctcaccagcactaattactctctcttcttgattttaaccattctagtggtgtgtagtatatcactgtggttttaatttacatttccctaatgggtaatgatctgagcatcttatctcattgttagccatttgtatatcttttttggtggaatgtctgatcaaatatttttgttcatttaaaaaatctgttcgttttttttttaaatattgagccttgagttctttgtatgttctagatacaagccctttattagctatatgatttgcaattattttctccctgtctatggtggttctttccatgtatttggatggtgtcgtttgaaatgcaaaaattgataattttttattttttattgatcatgcttttggtatctaagaacttacttgcctaacccaagctgttttttttttccattttcttccagaagttttacattttctactcctaaatttaggtttatgatccatttgagttaatatttatgtatggtatgaggtcaaatgtgtgtgtgtgactgtccaatttttctagcagaattcgctggaaagggtatccttctactattgaatcctcttgacacctttgttgaagtcaattgaccacaagtgttaacagtttatttctggactctctcttgccttccattaatctatatgcctatccttgtgctaattccacactatctttgtttaatgtggctttatactaagttttgaaatcaggtggtataattcctccaactttgttctttttcaaaattattttatgtgttttgggtgctttgtgttgctatataagtatgaggatcaatttttcaatttttttttgggggggtggggtcgcaggggacagtcttgcttggtagcccaggctggagtgcaatagcgcgatctcagctcactgtaacctctgcctcctggattcaagtgattcttgtgcctcagcctcccaagcagtgggactacaggcatgcaccaccacacctggctaatttttttgtatttttcctagaaacggagtttcaccatgttggccaggctggtctcaaactcctgacctcgtgatctgcccaccttggcctcccagagtgctgggattacaggtgtgagccaccgtgcctggcccaatttttcaatttctacaaaagaccttgctggcattttgataatgattactttgaatttatacatcagtttgagggagaattgccatctcaacaacactgagttctaatccaagaacggaagttctctatttatttagggtttttttttttttttttttttgagatggagtttcgctcttttgcccaggctggagtgctgtggcacaatttcggctcactgcagcatccacaccacccccaccccgggttcaagtgattctcctgcctgagcctcccgagtagctgggattataggtgcccactgccacgcctggctaatttttgtatttttagtagacatggggttttgccgtgttggccaggctggtctcgaactcctgacttcaggtgatccacccgcctcggcctcccaaagtgctaggattaaaggcatgagtcaccatgcccggcctatttagctttttaaaattttcttttagtgtttcatagttttcagcatacaagtctcatacttcttttgttaaatttatttctaagtattttaatatttctaatgctattgtgagtggggttgccttcctaatttcatttttgggttgtttgttgctagaatatagaaatacattgacttttgtctatctgtgtcaaagtcaaataaaaatatagagataaatctctaaacaaaatgttttctttgggaaaacagaaatgtaatttcgggcatacaaacagagtagagtagtcttcagtgtgtctacagagcaaagagaaggttgaggattttttttttttttttgagacagagtctcgctctgtcgcccaggctggagtgcagtggcgcgatctcggctcactgcaatctccgccacccgggttcacgccattctcctgcctcagcctcctcagtagctgggactacaggcacctgtcaccacgccctgctaatttttttgtattttagtagagatggggtttcaccgtgttagccaggatggcctcgatctcctgacctcatgatccgcccgcctcagcctcccaaagtgctgggattacaggcgtgagccaccgcgcctggcctatgaggattttattagaaagagaattgttgcatattgttttgaaagaaaagtcattggtacttgcaaagtttttagaagctggcaagctctgattggtgaatgacagtggtagataaaactggtcttaaggttttagcaggttattttggcagctagcttgcagtataatttctgggttggtgctttgtgccctgagtgcttttcttttcctcttgtcttgattctacttgggtatgacaagatagctccaattcatataatcagtttttcacacatgtatttggtgacatgaccaaacttatttatataagttttattaggtgtttttgtttttttatttgtttgtttttgtttgttttgacagagtcttgctctgtcacccagggtagagtgcagtggcgggatctcggctcactgcagcctccacctcctggattcaggtgattctccttcctcagcctcccgagtagctgggattgcaggcgcctgccactgcgcctagctaatttttctatttttagtagagacggggtttcaccatcttggccaggctggtcttgaacttctgaccttgtgatccactcaccttggccttccaaagtgctggaattacaggcgtgagctaccgtgcctggccgttttaatagttttttaaaaatttctttgggattttctacatataggattgttttgtgtgtgaatgataacagttttacttatcttccaatcttttttatttgtttattcctatttgttttttgtttttttatttgtttattccttattgcactggctagaacctctagtacaatgttgaatagaagtggtagaagccaacatacttgccttgttcctcctcttagggagaaaagcattcagtcttgttgtcaaatatgtcttctgcatctattgagatggttgtgtagtttttgtcctttattcttgtaatatattgtaacacaattatgaagaagtgtttggagagtaatacattcgctactagaacagtttaggtttgcttttgttaaggtgcgagaagttttacccaccattgcttttataacatcagtgcaaatgccaacccagtgaataaggtaaatgatgtctcaatattcctgtgaaaatagttttgactttgctgtcctcctgaaagagtctcagggaccccaagaggtttgccaaccataccttgagaatcactgtccagcttgattgtagtgggtttctttttttttttttttaactgaaccagctcaagttttacagaattaaaacatgtatgtttataaaggatatggaactgtaattttcttagactgttgctatctggctttgaatcaaaattacagtaatgttgtaaattaacttaagcagctttttcttttattctattttccagcactttataagacaaagaccacttgtttgaaagttttttagttttcttcagtaaagctacctgtggtgatgaggacatggagatgcataatagagttttacacttggcaacatgtattcatgtgggaaaactcagtgatgagtaactcaaagaggtgctgagaattcggtgcttgtacaccatttcatttattttttatttattttttaacttttaggtttggggtacatatgcaggtttgttatataggtaaattgcatgttatgggggtattatataccattttaacaaaggatgattaattgtgaagtaactagacaaaggcttgggctgctaggggcagtaaattgtgtgaaggtgactaggaaatgtttggtaaataagggtttagtaacacttgtcatgtagattcaagtcactgctgtctctagtgataagaatgatctccagtgattaagaatcttcctggtacatgagatagaacacctttacaaatgcaaatttatattacttttacaaaagggaaatttataccttacttttaggcagaaagggggaaggcagagagtttgttgcttcttagtgtctttagccaaagtggcatactttaggataacatttcctggtcccctttagaagaataatacaagattcagtgtcagtgtatggaagccaatcaatccccaattctgtcctggagaacacagggaaggcttcagagagaaggaaatttgagctgagaagtgaaaaattaacatgtattaggtatacatttgggataagggtatttaagttgaaacagtagcatatgcaagagaatagagacataatggtatggccttgtttactactggatgtaaagtgtgtgcatggtagattcttggaggcatgatgatgggtgggacaaattagcagggggctataccatgaagagtcttgattgtcatgctcatcactaatttggatatttatttatttatttggccatagcagttggaggattttgaacaggagatttatgtgatcatctgatagtttggtcaggggcatccagactagagtgactccatcttgattaaaggccagataaagccaaacctcctgggttacattcccaaggggttggacactgttggtcacaagatgtttagggttgagggaacaagttaatgatgctaactaacgaaaagatgcttatgaaacttatgaaatgtttcagtacttgaagatcaaaaagcattcttagtttaagaataggttttgctttcatacaaaattagctgggcgtggtgacgcgtgcctgtaatcccggctactcaggaaggctgaggcaggagaatcgcttgaacccgggaggcagaggttgccgtgagccaagatcatgccgttgcactccagcctgggcaacaagagcaaaactctgtctcaaaaaataaataaataaataaataaaaaataggttttgctttaaagataataatgcactcatgaatttttgctaaaatccgtagtaacatagggaaataacactactgatagcctgtcacagctgatcacaagcctttgtaatgaagtacactatccttaacaacctatataagcaagcagtatgtttaaggtaggggtgttcctcctcttgaattctgaggatgtcctgctctgtaatagagaagtctctaataaacttcgctatactctgtgacaccctgaattatttcctgcatgagatccaagaacctgctcttggggtctcagacaagacctcttttctagcgacagtcttctttaaacatgccactatagcttggatttgagccatgattgtaccaactaaaatgcacaataattactgccatcatattctcctacctaggtaatatcacttcctttcttgtactctttacatacgtgtaagccacccacattttaaatttaatttttattttgtcaaagaaatatgtggacataatttcaaaagtctgttagttctttaaagctaataaagggattttgaaattcccttaccccattcctaccatccttgatttttatttattgaaaccaactactttaaatttttttatctatttcagtgtcaaattaatacaacttaatattatttctaataaagtcattgtgcattatgattatgtctgttttcttttgcaactttttgttttcctgagggtaataatggtctcacttttgcattgctttatattctatgtagcaatcatttattcaccccaaattttctatcagagctccaaaatgtttttcagtatattacattagatgatttaatctcctaatttaatcttctcccccaccatactccatccttccagaaacatttcttctagagccttctcgtcttctcctccaactcagagtgattattttctagtccccttgcatatttatttgccatcatggtatttccagtatctctctctactgtgggttctgaattcctcagatcttctgccttcctcttggaagcctcctgtccttctgtgccacgactgcctgtgccaaaatatgttgtgagttctcttcttcacatatctaagtctcttcagctatgagcctctgaaggccaaggattgagtatacttgcacctttttgagtattttaagtgcctgacatagaaccttgcaattagctgtcattaaaaaatgactgtggaccaggtgtggtggctcctgccacaagcctttgtaatgcccagcatttagggagactgaggcaggagggtcacttgagcccagcagttcataaccagcctgggcaacatagtgagatcttgtctctatgaaataataaacaaaatttagccaggtgtggtggtgtgcacttattcccagctgctcaggaggctgtggttggaggatcacttaatcctgggaggtcaagtctatagtggactgagattgcaccactgcaatccagcctaggtgacagagtgaaaccctatctcaaaaagactgtgttttctgatcatggcatgtgacaaataatacaaatgaaataaaaaataaaaaattgagggtaaaagaaaaaacagaataataaaaagataaaacaacaaccataaaaatgaccatgatgatactggtctattgaaagtggggggcctggtccttatgtagcgtctctacccatggctgcctcgtagaaactaactgtgttctaatcttttctgctatggaaatttgggcacaggccagacagctgggcaatttattgaggaaggaggtagaaaagaaggattgttactaatacaggatgggtttaatctgtattagtagcagattaaactgtgtattaagtaacagattaaagtatgtattagtaacacttaaactatgtatgtattgggccaaaatacatagtaattacaggacattttgcatttcctgtcaaccactagctctcaaagctactggtctagaaatgtaacctgtgagtgggcttataatttggagcttccagagaaatccagaggccatgggaactagtaaagacaaaccaaatataccacaacttcccagacactatgttatcagggcagtctatactagttccaaggcccatgtttgtggatggcctcagtagtggaagtgtactccattcagagaaaaaaatctatagtctcactggctgctttcctttgattaccaagagatgtactgctttaagaatacattacaaaaccattatctccctttccttaattctccagtctctcccattcattaattctccaaataataaacatgtatcaggcactgtcctggacactggaaatataggcatgcctagaatacccagaatctgaggcagtgcccagtctagggtttttaaatttttctcctatctcttttaccaggttgattccattagaactgtgtgaatgtcaactgcaaataatcaaagacagaattatcttgttttcttggtggtggggagatttactaaggtgtggtggaaaatcctatcctcatcttgagactggggatggagacaagttgcctgtcatgaagggaacttgctactacgtcacataaattattccagggcagaagattgtactggcttatatttggccaatttcctccctctctttatgtcttttctttaaaacccttgattccttccaagtgttcttagtctattaaattcatgatatcttgggcttggcattccaggtttagacctgtatttgtttcttttccctgtaagttgtaactgttgcaggaacatgtagcagagatgtttagatttggctggtataatctgcctgggactgaattatgcttcctttgcattgctggtggtcttttctgctataagatatagtgaaaggattcaggattgttcagtgtagagataatctgtacctctttattttttgtctggctcaagatagcgctctctttattgtgtcctgatatagggttgatagtcacaatagtagtcaaggtggtcacgactaaagactttggtgggagcatactgtttccttagtctctgtcatagcagacctgctccccaatatttgtgcctacgtcagagttttgcaccagtccctagggtacttattgctgtcctctcgtccatgaagttaggccacataaaatgcccttgattttctggatacttgacttttagatcatttgaggatgaagcaccacactaagaaagtccgagggcaaagaaaattcaagttagattaggccttcaaataatgttattattttatcttgacttagggaaagctatgtagcatttcttagccttcagttccttgtccaaataaagggataataatagtcgctgcttcatagggtgtgagatactacatgtaatgctttaaaccagggttgttagttttacaagccaatcttttggcttccctctgccacataggaagaattgtcttgggccacacacagaatacactaatgatagctgatgagctttaaaaaaaaaaaaaaaaaaaaaaaaacccaaacacctcataatgttttaagaaaatttccaaatttgtattgagccacattcaaagctgtcctggactgcatgtggcctgtgggctgccagttggacaagttagctttaaaccaagcccagtgagctcttagtaattgttagatattatcattgttgttttaaatgcatagctgatttcagcagaacatgaggaaaaccctgagggacccaaatcagagagagaaaacaacacctaatcaataagagtagaagtgctagccagagcagtaggcaagagaaagaaataaagggtacccaaatagaaagagaggaagtcaaactacccttgtttgcagatgacatgattctatatgtagaacacctgatagtctcagcccaaaagcttcttttatttttttgagacggagtctcgctctgtcgcccaagctggagtgtagagggcccatctcggcccactgcaagctccacctcccaggttcatgctattcttctgcctcagcctcccgagtagctgggactacagttgcccgccaccacacccggctaattttttgtatttttagtagagacagggtttcatcatgttagccaggatggtcttgatttgctgacctcgtgatccacctgccctggcttcccaaagtgctgggattacaggcatgagccactgcgcctggccccaaaagcttcttaagctgataaacaacttcagcaaagtttcaggatacaaaatcaatcactagcagaaagcactagcattcctatccgccaacagcagccagggagagagccaaatcaggaaggcagtcccatttacaattgccacaaaaagaataaaatacctaggaatacagctaaccagagacgtgaaagatctctacaatgagaattgcaaaacactgctcaaagaaatcggagaggacacaaacaaatggaaaaacataccatgctcatggataggaagaatcaatatcattaaaatgatcatattgcctgaagcaatttatagattgaatgctatttctatcaaactaccaagagtattcttcacagaactagaaaaattatttaaaaaattatatggaaccgggccgggtgcggtggctcacgcctgtaatcccagcactttgggaggccaaggcgggtggatcatgaggtcaggagttcaagaccagcctggctaatatggtgaaaccccatctctagtaaaaatacaaaaaattagctgcatgtggtggtgtgtgtctgtagtctcagctacctgggaggctgaggcaggagaattgcttgaacctgggaggtgaagattggagtggactgagatcatgccactccattccagcctgggcgacagagtgagactccatctcaaaaaaaaaaaaaaaaaaaaaaaaaaagtcatatggaacaagaaaagagcccaaatcgccaaggcaatcctaagcaaagagaacaaagctgacttcaaactatactacagggctacagtaattaaaacagcatggtgctggtacaaaaacagggacataaaccaatagaacagaacagagagcctattttaaaaatcaggggttttaaaatcgtaggccacacacctatgataacctgatctttgacaaagctgacaaaaacaagcaatggggaaaagactccctattcagtaagtggttctgggataactggctagccataagcagaagactgaagctacatagtacccctcctttacatcatatacaaaaatcaactcaagatgcgttaaagacttaaacgtaaaactatgaaaaccctggaagacaacctaagcagtaccatcctggacacaggaatgggcagatttcatgacaaagacaccaaaagcgattgcaacaaaagcaaaaatggacaagtttaattaaacttaagaggttctgcacaacaaaagaaactatcaacagagtaaacagacaacctacagaataggaaaaaatatttgcaatctgcatctgacaaaggtctaatattcagcatctataaggaacttaaacaaatttacaggagaaaaacaaccccattaaaaagtgggcaaaggacgtgaacagatacttttcaaaagaaggcatacatgcgaccaacaagcataagaaaaaaagctcaatatcaccgagcattagagaactgcaaatcaaaaccacaatgagatctatcatttcacaccagtcagaatggctgttgttaaaagtaaaaaaataacagatgctggcaaggttgtggaggaaagggaacacttacacactgttggtgggagtgtaatttagttcaaccattgtggaaagcagtatggtgattcctcaaagagctaaaagcagaagtaccatttgacccagcaatttcattactaggtatatacccagaggaatataaatcattctgccataaagacacatgcacacgaatgttcattatagcactattcacattagcaaagacatggaatcaacctaaatgcccattaatgatagatgggataaagaaaatgtggtacatatataccatggaatgttatgcagccataaagaacaagatcatgtcttttgcgagaacatggatggagctggaggctacgatcctaagtaaactaacccaggaacaggaaaccaaataccgcatgttcttacttataagtgggagctgaatgaagataactcatgaacacaaagaagggaaaacaacagacattgaggtctacttgggggtggagagagagaggagggagaggagcaggaaaagtaactattgggtgctaggcttaatatctgggtgatgaaacaacctatacaacaaacccctgtgtcaggagtttacctatgtacctgaatatgtacccctgaacctaaaaaataataataataacagtgggagccagctttgaagcttccaaaaatggggtcagggaggagatgtgctagtctcaataaccttgaggggaaaaaagatgaggtcttggcttgtttagtgtaagcaattagaatggacaccccctacatacaattaggaccctcaaaagacttcaccctcagtgcaggaatggactaggaaaaccactggcatgtacagataaaaagaactttcttaatctcatctggattttaaatagggcttttaataaaggaaagacgtctcccttgaaaatttctacctgtaagccttcacttaactgaaattgggggttggagtttatactctttgtgtggtctagaagctggttctgggctggtaataactctggctcatctgtcagaaacaaacttaacacttctattaagtgacataccctcaaatcaggtatcataggattctcataaatgcagcttcactgaaggtaagtttgtagtacaaaattacaaaccaaccaaccaatctcccctaagtgaaaatcaatagataaaagaaacagtttggaacttcagaaagtagcattagagggtgggcacagtggctcacaactttcatcttaatactttggatggctgaggcgagtggactgcttgagcccaggagttcgaaaccagcctgggcaacatggtcaaaccctgtctctacaaaaaaatacgaatgttagctgagtgtggtggctcatgcctgtaatcccagcactttaggaggctgaggtgggaggatcgcttgagcccgggagttcaagaccagcctgaacaacatagtgaagtctcatctctactaaatttttttttttttaattagctgggcatggtggtgcatgcttgttttctcagctacttgggaggctgaggtgaggattgcttgtgtcagggaggtcaaggctgcagtgaactgtgattgtgccattgcaccctagcctggatgacagagtgagaacctgtctcaaaaagaaaaacaaagtaacattagagattaagactgtaagattagtatatttaaaattattaagaatataaaagaaggaggctggacatgatggcttatgcctgtaatcccagcagtttgggaggacaagacgggcggatcacttgagcccaggagttcaagaccatcccagacaatatggtaaaaccctgtctctacaaaaaatacaaaacttagtcaggcatggtagcatgggcctgtggccccagctaccctggaggctgaggtgggaggatcacctgagcccaggaaatagaggcaacagtgagtggagattgagccactgcactccaacctgggtgacagagtgatcccctgtctcaaaacaaacaaaaaagaatataaaagaaggaaacagaaacaagagaaaaaaagaccaaatatatttggacaaaaagctaattagaattcgaggaataaaatatatgtattgtgttgttgaaattgaaaatgcaacagtcgtgttaaataatagagctgtggacaaagtaaaatttttatcaagagtgcaagacagaaatgggaagatataaactatgaatgaaagctaagaaatacagaagatatgatcagatggtccaacagaatatggagaaatgggaagaggcagtattcatagagataatgactgagaccttccagaactgattagaaacaaacaaggaacatcttgaagcatggtgagtccccactataataaataaaaataaatccccatctagatacattgcagtactgcagagccatgaaaacaaagagaatatcttaaagaaccctcaagaattcactaaagtaaaagagctcagcaagaaagttcactcaagaaaattgaaaatatatgttcatgcaaaaacttgtaaacaaatgttcacagcagcagcatctatgataaccaaaaagtagtaacaacccaaataccttgtcattttatgaaaggattaacaattgtggcatggagaatttatgcatgccacaacatgcatgaaaacatgctgagtaaaagaagccaaagactacataatgtatgattcagtttctgtgaaatgtccagaatacgtagagtccacagagacagtgaatccatagagacagtacgttggtggttggttgtggggagaatgggatggagaatgactgctaatgggtacaaggtttctttttggcaatgaaaatattctggaattagatagtggcagtgcttgcacagccttgtgaatatactaaaaatgaatgagttgtacattttaaaagggtgaattttatattgttggaaatatatctaaaaaaataagttaatggttaaaataaagcaaccagacagaaaaagaaaaattaagtacaaaggaacagcacttatgctaagagtaagcttttcaacagcaataacaggagccataagactacagaataatatttttaaagtattgagaaaaaagttactctgaacaagacactagaattatccatacttgctaaattagcagtggaagtgagtgaccaaaaaaagccattttcagaccatcaaaaaccaagagaacaaaatctatagagaagatttattactatcagatcctctctgaaataattactacaggatatatttcagaaacaaagaagaaatacatgagatcccaagagggaatgttaagcagtgaaattagaaaatacatgagtaaatctaagcaagcaattattgtataaaataataattactaatttggcaatgtaaaagtaagatagacctgaaataatagattgtaataataggtaagttgaaagggagtgggaggattggagttaaaagcgatctaggatcttttaattttgttcagaaagagagttgaggtgctggttaactttagacattgttgagacaagaacacctattaaaccttgaataataacaactactttaggacagaaaaaaacaaaacaatatgtaatttctaaaccaatagagcagaggttaaaaaaaaaaacttgattaattcaaggagagttgccatcagacttggaggaaaactttaccttagagcaaagacttttctcctagttcctctgatgcctgctgcccttgcggggaattctgactacctgcttctgtggaaatacattcatttgttcaataaacacttgtcgaaaacctcctatgccctgtgtactatttctaggtgattgggatacctcttagagctcactctagaaaagaagaaacagacagtaaacatagtttatgtagtatgttagaagatgacaaatgctattgggaaaaaaggtagaccaaaggggattcaggaaaacagaaaattgggaaggtgacattagaataaagccttgaaggagtgagggattttgccattgtgtagttgaaggaaggacattgcaagtaaagggaacagttaacgctggtcctagtagctagaagtgcctgtgcaaaattagcagcctgtggaaggttttgagcagaggaatgaaataatcagatgtgtgctttaaaagaatcactgtggcttgctcatattaagaacagattagggtagaagacaagagtaaaccagagagactagttaggagggtattgaaatccaggtaagcaataaataatatatcaataataatataatggatacgtaataatatctccctttattggggagggaatatgtatttttttcccactctcacttccccatcttaaccaggacatcttggttgttactctgaaatattatagcatctggaagtgcttgactgtaaccagctccacattcttctttatattgtttacacttactgaaacagaagtgatcttttcctcattctaaattctaaaaggtgcctgccaagtactatccagtcacggagtgctcaagttcctaggagcagctagacctctgagatttggagactggagagacctaagggatctgcaaccagacatcttattccataccctttgttgcttcacagtgggaagcaggcttcctaagtaaatttacagcagctcttgcaggggtcagattttccgagtgcctgctagttgctggagggaggggtttttgaaggctagaaacgatctactactctccaaatgtggttacaattcaacattgtcacagagaatgcacgatatgccttagcccttgttcttgctgttgactgagatgaccatggcgaggtatgtaagaaattgaaatgccaagtctcactccaagtagccaagtgactgggatgatttaacaccagtctttgcatgaggtagctccgggggcttccaggctaccacccgtccgctgagagttagtgtacccaactctgcagatatccagtacttcatcttactggaatgaaagaattaagacttgccctttatcttcttaggatcctggggaaatggccagagcctgttgaaatggaaaaattagccagttccttgttgtggatctcagctgagtcatggtatctgtagcagagtgtctgacctttttttcccctggcagctgttaaagatttgccaagtgagattatgtgtacctttataaaaaggcatgtggcctggaaatacgatctttagtgttttggcttttattttaaattttaaataaggttaaggcaaatgaagctggaattaattatccgtccctgaagtttcaagacattttcactttcagacacaaggatttagatataacagtttgatttacctttcataggccaggtatacatgtatcttctttattttaatccttgtaacaaatcatactcatccattcatttaacaaatacttattgagagcctactgtgtgccaggcagcgttctaggtattgaggagtgcagcagtacacaaagcatacaaaagcccctgccctcatacagtttaatttctgatgagaagagagacaacaaaatgaatgtgcaaaatatataccatcatatatatattggggattagttccaggacccacacggataccaaaatctgcagatgcccaagtctcttatataaaagagcatacataatattcgcatataacctatacacatcttcctgtatactttaaatcatctctagattatttataatatctaatacaaagcaaatccctgcaaatagctgttatactatatttttaaaatttatattattttaaaagttttaaaaaatattttccacccatagttggttgaatccatggatgtggaacccacatgctgactgtagtgtgttagatgatgataagtgctaggagaaaaatatatcaagaaagggggatagagagtttgggagggtttgcaattttaaatagaatgatcggggaaaattcacccagaagattgtacttgagcaaagacctgaaggaagaggggagcaagccttgaggcaacctgggagaaacataggcaaaggaaatcccaattgtaaaggccctgagatgggtggctcgcttggcattttctaagaaaggcgaggaggccggtgtggctggagagtgagcaggagggagagaggtcatggagaatccagaccatataatgccttgtaggccatcatcagaactggctttttctctcagtgagacaaggagaattttaaatggaagagggacatgatgttgcttacattttaaaatttttgtatagttttattgaggtatgattggaatataatagattgtatgactgtgataatgaacatgaagataatgaacagatctataactctcagaagtttcctcatgactatctataatccattccttgcttctcattgggcaactactaatctgcagtctgtcactatagattagttagcattttctataattttatataaatggaattggatcaactaaacaatttgtccttgtgagtcccaccagtgaaatttcttaattgtggtgggtcaaattcaaattttatttttttagtggttctacttttgagaaaatttttatttcacctctcccaatggatagatgtttatttcaagatacattgcaacctattgtcaacacttcaaacctgccaatcattgacttcttgaaggagtgtaatttgttatctatggctcctaaatgttcctcatatcaccaacccttactgtgggtggtacaatgccagtataataaagacagctattcatggaaatttgttcactgcaattgccaatcagcatgagtctgtctttgaaaggattattttttcacaaaatccagcatttccctgaataagtggcttcatcttcccttgttatggtctatggaagtcacagagagagcaactactgctgttactggaatttcagtccatactatggtcagtgtccacaatttctgtcacaaagtatgcaagcattactttgaactacatccgatacagcttagtggtttaggtcattacttgcaaatcagtgagtcctgttttagccacgaaatcaagtgtcactatagccatgctctggagagagaaataatgggcttttggtatggtggatacacccatcagccagctattggttatttggaaatttttggtgactgttctgcccaaaccttgccacctattttgcagtgcctagttgagcacagttcatatcatctcttggcatacatacccaaaacatctagtgctattgaaataaatgcaaagcaaagtgcaagaccatgagaggaattcgtcacaatgtgttggactcgtatttggtcgaatttatgtgggatgattgacttggaaataatgttttcaattcccttttagcgcatgtgtcagaacagtctcctgttaagtaacattatgtttgacttttgtttttagtatattttagtataaatatccagggacaaattttttgattgaatacacctgagaggcaaattgttcaactcatccatgaaagcatacaacatactcttttttgtctggcatcttgctttcagcataattatttgtgagattcatccattgtgtgaatcaattattcattccttgttattgctgagtagaattccattatatggatatactgtgatttgtttgtcactcatctgttggtgcatattttaggtggtttgtagtttcgggctttcacaaataacagcatataagtggatcctgctattttatccagtctgacaatctctgccttaactggctgtgtacttagaacatttatatttaatatgattattggtatgattgggtttaaatatgttatttgttttctaattggcccaactgtacgtgttcttctttttctggcacaatcattggctcactgtagccatgaacccctggagtcaagcagtcctcctgcctcagtcacccaagtagctaggactgtaggcatgtgccaacatgcccagctatttttttttaatttttattttctgtacagatttgaggaaggaaaaggggtattggaggtttaaggagaaaatgtgaattagttgtcttggagagtgagcaaacacattactctggtaaatgtgctaagattgtcaggcagtaatgaggccccacttgatgtttgtcactgtgaatataaagacacatcagccagcatgattctgggtttttcttcagtcactctaagttcccaggtgcagttgcaaaatagatgggaagcttggttgtaaagggttgggatttcgccaggactttggtgtccttgggaggtagcaacgtttcatttggagctagaatttaaagcagacactcagaagagaaattggggatataggcagtttgctgatgacatactgagttcaaggaggcaaagtataagcttttctcaaaggttcagagtagtgggagactgtcaggttagagagtggaaggcattccatggtgactgaggtagttaggggtatgggcatgattggattcctcctgatggtttcttaggggaaaatggttatcatttctaatgataatctctttcttgagattgatctcattccttccatcagccctacagagtctggctgtggccttccccatagcttctataacctacttctttttctgtcattctcccctcctgtcatccactcttgacttctttgctatttcttgaacatcccaaatttgttcttgtctcagtgcctttacctttacttttctctctgcctctcagctctacttttgtctgagtccttcatatcattcagctctctcatcagacttcacttccctagttagcactcccacaccagtctcttatttcctttctccttttctccctctccctccctccctctctctctctctccctctatccccctctccccctctccctctctctccctctttctgttctttcttcctcttccttttcccacagcactgttcactccagttatgaggatagagactgttcttttgttccctactgcttccctcctaagacactgcctagtgtgtagtaggtgttcaataaatatttggatgaatataaatggcaaacttccctaatgccttcaaaagatagactgactttcaaataaattgatatagacttttcagtaatagatgttgcatgaaatggcttttcatcaccatctggttttctccaaccagaagaaaaagcttcagacattaacatgtagtggaaagcccgtttatagaagaaacccagggctgttctgacatttattctgaaatgagaatattacttaattcacggactaaacgttctaaaaataataatttcatagattaatagttttggggggttcttagagaatatgagaatattttgacttgtgctttttattttgtaaatcaatttgcagtggtcattcttcattagatactgtttaaaacatggtttttgcccgtagggagctccttgtgtttgcttgggaaataaaactaaacattggaaaagcacagtggcaatacaagatgaaagtcaaggcagtgaaaaaagttattccaaggaggaacacagtgctttatggaatctaactggtgccgagtgtaattgctgacccagttcagtttaaagaagtatactgtgcggcccgtggaatggtgtccctctttagttccttaaaaaccactcaaggtctctgggcccatggtgtggccctattataattcatattttgttttcattgcagttgtcggacaagtaaccgcaagagcttgattgtgacctctagcacatcacctacactaccacggccacactcaccactccatggccacacaggtgagtgcttgaaggttaagaaaggttgaatgaaagagtggccacagatgcccaatttctttcctacttctcatgttgtgcagttccgtatattacattgtcactttacttggctgactgaagcagacagagctcatgggcttgctttctgtacgagaatgagttagcctgcttttgactcttagttgtttcttaccttgttctctcaacattccttttagtcttgtacatatcttggggccaggtatgtgtcctgggtttatggcctctgttctagtgtgttctagtgtgttacagctccattcgtcttgggtcatttgatgaggagtccactaatattttgtactaccgtgcccaaggattagggctcacagagagggtttttcgtctaatgggactcctgttaaccttcctgctcttagattaggagataacaaaagcaagaggagtatgtgtttgtttgtttgtttttaaatagaaacgaggtctctctatgttgcccaggctggtcttgaaatcctaggctcgagtgatcctcccacctcatcctccaaagtactgggattataggtgtgagccactgcacccgggttggagtatttgtttcataatgatactgatattacatactggaattaaagcaaatgacctcatggattcaggctgctctagccctggaatatgggctcttcccgacagtataaggactgatttacatggctctgaagaatagataaaaattatgaggcagctgggcacagtggctcccgcctgtaatcccagcactttgggaagctgagatgggccaattgcttgagcttaggagtttgagaccagcctgggcaacatggcaaaaccccgtctctacaaaaaatacacaacttagctggacatggtggtgtacacatgtagttccagctacttgggaggctgaggtgggagcatcgcctgatcacctgagcccatggaggttgagatcataccactgcactccagcctgggcagcaacagaatgagaccccatctcaaaaagaaaaaaagaaaagaaaagaaatacgaggcttccattgattctggcacattgtccttcccagagaggggcagaagaaagacctcatcggagtcagccatgtgcttctgtgtagaaggtatattcttgtatcccaggggaaccaggccacgggactcagctttgctgaaagggctgcagcacttctgtgcagttcattgctacactctttataatggaagatctaaacctacagttagtggcaattgacagacttagaactgttcagagcttgctgcctgggcatagaaagccatggtcactgttgtcctaagcctggaccttgtctgtctttgggcgttaaagcaggatatcaaagcagtgaaatgggtcagcatcaagctgagtaagatgtgtatattctccatgaatttgtttccttgctcacagtttactgtctttggagggagaaagtgagggtacatgtggagtatttgagggtcctgagagtctggtgattctgaaactgaactttgtccttgggagaaggatctcaccttctttggctcagattctcttagcctagaagccagccttttagtgtgatgatggcccctttccaagaatcagtaaatctctcaatcacaagctgtcactttagaagataccaccaagagaacagggatcccagggaactggagacatacttgacctttaaagcaaagctctcattgtgcttaggtgctttcctctaaaaaaattgactgaaattagctggattagctcaaacagcacatcctagatttttagagaaactcagcatacatctatctgacctgacctttttatcatataggaataaatttaacatgtctagaccttgtatatagttgcacaactaatgtgagtactgagcagtagttactactggctgctcttctctagatgattatctctctatttagattctccacagttagcatttagaactaaatcttcctactcaagtggatttgattgagaacaccacctggccttttcagcctgcctggatctgtagactccagctttgagttaatgtgtgtaacatgcttagtactttacaaatgttagcatctgtattatctcttagcaaatcactgcagaaaatctagggggcaagaatggacataaaagcccagtttgtgactgtagactatacttatccagctgttgagacaggcagcactgattgttccacgcagatcccacatggcattagattatatcctcaaatctttttttttatagataattttattatactttaagttctagggtacatgtgcacaacttacaggtttgttacatatgtatagatgtgccatgttggtgtgctgcacccattaactcgtcatttacattaggtatatctcctaatgctatccctcccccatccccccaccccacaacaggccccggtgtgtgatgttccccttcctgtgtccagtgttctcattgttcagttcccacctatgagtgagaacattcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagcctttgctattgtgagtcatgccgcaataaacatacaagtacatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgcaagatgatatctcattgtggttttgatttgcatttctctgatggccagtgatgatgagcattttttcatgtgtctgttggctgcataaatgtcttcttttgagaagtgtctgttcatatccttcgcccactttgtgatggggttgtttgtttttttcttgtaaatttgtttgagttctttgtagattctggatattaaccctttgtcagatgagtagattgcaaaaattttctcccattctataggttgcctgttcactctgatggtgatttctttttctgtgcagaagctctttagtttaattagatcccatttgtcaattttggcttttgttgccattgcttttagacatgaagtccttgctcatgcctatgtcctgaatggtattgcctaggttttcttctagggtttttatggttttaggtctaacatttaagtctttaatccatcttgaattaatttttgtatacggtgtaaggaagggatccagtttcagctttctacatatggctagccagttttcccagcaccatttgttaaatagggaatcttttccccatttcttgtttttgtcaggtttgtcaaagatcagatggttgtagatgtgtggtattatttctgagggctctgttctgttccattggtcgatatctctgttttggtaccagtaccatgctgttttggttactgtagccttgtagtatagtttgaagtcagatagcctgatgcctccagctttgttcttttggcttaggattgtcttggcaatgcgggctcttttttggttccatatgaactttaaagtagttttttccaattctgtgaagaaagtccctggtagcttgatgggggtggcattgaatctataaattaccttgggcagtatggccattttcacgatattgattcttctatccatgagcatggaatgtttttccatttgtttgtgtcctcttttatttcattgagcagtggtttatagttttccttgaagaggtccttcacatcccttgtaagttggattccttggtattatattctctttgaagcaattgtgaatgggagttcactcatgatttggctctctgtttgtctgttattgatgtataagaatgcttgtggtttttgcacattgattttgtttcctgagactgctgaagttgcctatcagcttaaggagattttgggctgagacaatggggttttctagatatacaatcatgtcatctgcaaacagggacaatttgacttcctcttttcctaattgaatatcctttatttctttttcctgcctgattgccctggccagaacttccaacactatgttgaataggagtggtgagagagggcatccctgtcttgtgtcagttttcaaagggaatgcttccagtttttgcccattcaaaactggctgtgggtttgtcataatttattgagagtttttagcatgaagtgctgttgaattttgtcgaaggccttttctgcatctattgagataatcatgtggtttttgtctttggttctgtttatatgctggattacgtttattgatttgcgtatgttgaaccagccttgcatcccagggttgaagcccacttgatcatggtggataagctgtttgatgtgctgctggattcagtttgccagtattttattgaggatttttgcattgatgtttatcagggatattggtctaaaattctctttttttgttgtgtctctgccagtcttttgtatcaggatgatgccggcctcataaaatgagttagggaggattccgtctttttctattgattggaatagtttcagaaggaatagtaccagctccttcttgtacctctggtagaattcagctgtggatccatctggtcctggactttttttggttggtaagctattaattagtgcctcaatttcagagcctgtcattggtctattaagagattcaacttcctcctggtttagtcttgggagggggtatgtgtcgaggaatttatccatttcttctagattttctagttcatttgcatagaggtgtttgtagtattctctgatggtagtttgtatttctgtgggatcggtggtgataacccctttatcattttttattgtgtctatttgattcttctctcttttcttctttattagtcttgctagcagtctatcaattttgttgatcttttcaaaaaaccagctcctggattcactgatttttttgaagggtttttttgtgtctctatctccttcagttctgctctgatcttagttatttcttgccttttgctagcttttgaatgtgtttgctcttgcttttctagttcttttaattgtgatgttagggtgtcaactttagatctttcctgctttctcttgtgggcatttagtgctataaatttccctctacgtactgctttaaatatgtcccagagattctggtatgttgtgtctttgttctcgttggtttcaaagaacatctttatttctgccttcatttcgttatgtacccagtagtcattcaggagcaggttgttcagtttccatgtagttgggcgattttgagtgagtttcttaatcctgagttctagtttgattgcactgtggtgtgagagacagtttgttacaatttctgttcttttacatttgctgaggagtgctttacttccaactatgtggtcaattttggaataggtgcggtgtggtgctgggaagaatgtatattctgttgatttggggtggagagttctgtagatgtctattaggtccacttggtgcagagctgaattcatttcctggatatccttgttaactttctgtctcgctgatctgtctaatgttgacagtggggtgttaaagtctcccattattattgtgtgggagtctaagtctctttgtaagtctctaagttaaggccttgctttatgaatctgggtgctcctgtattgggtgcacatatatttaggatagttagctcttcttgttgaattgatccctttaccattatgtaatggccttctttgtctctcttgatctttgttggtttaaagtctgttttatcagagactaggattgcaacccctgcctttctttgttttccatttgcttggtagatcttcctccatccctttattttgagcctatgtgtgtattcagtattaaatatctactacataagtaggttacagtgtcagtaatgtcagttcagtaggtacatacccagccattcgagaaatggaaactccctaccttattttttttttaattatttcttagagtagttttaggttcacagcaaaattgaggaagatactgagataaaccatataccccctgccctcacctatatataggctccccattatcagctccctaccagagtgctacatttgttacagttgatgagcctacactgacacatcacccaggcactagtttacattaagattcactgttagtggtatacattttgtgtgtctgggcaacattatcatttaccattatagtatcatacagtcttttcactgtcctaaaaattatctgtgctctgcctatttatttctttctccccttaactcctggcatccagtaatcttttgactgtctccacagttttgccttttccagaatgtcatatagttggaatcatacaatagccttttcagactggcttctttcacttagtaatacgtactgaagtttcctccatgtctttccatggcttgatagctcatttctttctgaataatatcctgttgtctggttataccacggtttatttttatccactcacctactgaagggcatcttggttgcttctaagttttggcaattgtgaaaaagccgctataaacatctgtgtataggtttttgggtagacgttaatttttaacttatttgggtaaataaggagcacaattgctatattgaatggtaagagtgtatttgattttgtaaaaaaaaaaaaaaaaaaaactcttcaagctgggcgtggtggctcacgcctgtaatcccacactttgggaggccaaggtgggcagatcacttaaagtcaggagttcaagacaagccgggccaacatggtgaaatgtcgtctctactaaaaatagccagacatggtggtgtgcacctgtaatcccaggtacttgggaggctgacgcaggagaatcgcttgaaccagggaggtggaggttgcagtgagccaagattgtgccactgcactccagcctgggcaaaagagtgagactctgtctcagaaaaagaaaaagaaaaactcccaggccgccttccaaaggggtggtaccattttacattcccaccagcagtaaatgaatagctcctgttgcatcatatccttgccagcatttggtggtgtcagtgtgtggatctgggtctttttttttttttttttttttttaaggcagggtctcacgccatcattcaggttggagtatggtggcacagtcacagctcaatacagccttgagctcttaggctcccagattttggctattctaatctatgcgtagttgtatctcatttaattttcaattcctggcggagcacgatggctcacacttgtaatcccagcactttggggaggcccaggcaggcttttttttttgagagagagtctcactctgtcacccaggctggagtgcagtgatgcgatcttgggtcactgcaacctccacctcccaggttcaagcgattctcctgcctcatcctcccgagtagctgggactacaggtgtgtgccaccacacccaactaattctgtatttttagtagagatgacgtttcatgttggccaggctggtcttgaactcctgaccacaagtgatctgcctggctcagcctaccaaagtgctaggattacaggcgtgagtcactgcacctggccttgcatataacttttgactgccccgaaatttaactactaatagcctgctgttgaccagaagccttactgataacatagttaattaacacataatttgtatgttttatgtattatatacgatactcataacaaaataagctagagaaaagaaaatttgttaagaaaatcactggaagagaaaatatacttactgttcattaattggaagtgtatcatcataaaggtcttcgcctcatcatcttcacattgagtaggctgaggaagattaaggattagtcttgctatgtcaggagtggcagaggcagaagaggtggaggaggtggaaagggatgcaggagtggcaggcatacaacttttactgaaaaaatttgtgtataagtgaacccgtacagttcaaacctgtgttgttcaaaggtccactgtaatccaaatcaaccttcaaataccactataccactttgccttatgatggcaaaatacacctaaatcctctcttcagtaccttgtaattttgctgtcattcatttcacttatatataagcacatgtgtgtacgtgtgtgcataatgtatgtaaaagcatacctaatcacatacattgttgctgttacagattaagcacccccagtccaaaaatctgaaatccaaaatgcaaaactttttaagcaccaacatgaacctcacaggaaatgcttgttggagccttttagattttgggctttcagatttgggatgttcagctggttagtataatgcaaatatttcaaaatcagaaaacaaatttgaaatttaaaacacttctggtctgataagggatacttatcctatattatgttgaacagacttatctattagacaaattaagaataagaaaaacaagtttttagtttaccttcatcacttctccagtgtgcttgcttgtttcatgtagagttcactttctcccctatataattttctctctgaacaacttcttttaacatttcttgcaaggcagatctactgctatagaatcccccattttttgttagggaaaatctttatttcttcttcacctttgaagtataatttcacagggtacagaattttaggttgcttgcttggtttttttgttgttttttttttttgtctctcaacagttttaatatttcactccactatcttcttgcttgtgcggtttgtgagaagttggatgtaattcttgtcttcgctcctctgaagataaggtgttttttccctctggcttctttcagatttttgtgtacctttggttttctatagtttgagtatgatatgtctaagtgcagtttttttctgaatttatcctgcttggtattttctgagtttcctgaatttatggctttgtgtctgactttaatttggggaaattttatgtcattattgcttcaaataattcccttcctttctctctttttcttcttgtattactgctgcatacgtatcacaccttttgtaattgtctcacagttctcggatgttctggtgttggttttttttttttcggtccttttttctttgctttttagttttggaagtttctgttatcatatcctcaagatcaaagattatttccccagcagtgttcagtctattaatgagcccatcaaaggcattcttcagttctgttacagtgatctttaacattttcttttgattcttccttagaatttctatttatattatccatctgttcttgcgtgttgtctacttttcccattaaagtgcttagcataattaatcatcgttttgaaaaattcctagtctgatcattgcaacattcctgtcatatctgactctggttctgatgctttttctgtctcctcaaactattttttgctttttagtgagctttgtaatttttttgttaaaaggtggacgagatgaactgagtaaaagtagctgtgataaataggcctttagtaatgtattggtaaggtgtaggggaggagaagtgttccatagcagggatccgcaacccctgggccacggaccggtacttctcatggcctgttagaaaccaggccacacagtaggaggtaagcgtcagacaatcaagtgaagctacatttgtatttacagccgctccttatcactcacattaccgcctgagctctgcctcctgtcagatcagctgcagcatttagattctcataggaccatgaaccctgttgtgaactgtgcatacaagggatctaggttgcacacttcttattagaatctaatgcctgatgatctgtcactgtctcccatgacccccagataggaccatctagttgcaggaaaacaagttcagggctcccactgattctatattatggtgagctgtataattatttcattatacatcacagtgtaataataatagaaacaaagtacacaataaatgtaatgtgcttgaattatcctgtaaaccccttgcctccccacttcctggtccatggaaaaattatctgccatgaaaacagtccctggtgccaaaaaggttggggaatgctgttctatagtcttgtgactaggtctcagtcttttgatgagcctttgtccctggactgtgaacttctccagtgcttctcagtatttcccccacaccatagctgggacaggatggttcttggctgctggaattgggtatttcttcccccaagtagagctggcattgatgaaatcccagcaagttagatgcaaacaaaatagtttctcccaaggacaggcttgttaagaacagaatgctccggcgcgtatcaaaacagttccttttccctcctcctgctggaatcatgagattttcttcagtaatcactgtgaggatccagtaaggctcctttggataaaacttacaaaaatttgggagcccccccatgactagatccccctggagtttttaactctcagcataatccacactgagcttccagcaattcctcagttacagttcaggtcttcctgccctggcactggttgctatggaggtttctgcttaagaatttctgctcctgccgggcacggtggctcacacttgtaatcccagcactttgggaggccaaggcaggcggatcacgaggtcaggagttcgagaccatcctggctaatatggtgaaaccctgtctctactaaaaatacaaaaaaaaaattagctgggtgtggtggcagctgcctgtagtcccagctactcaggaggctgaggcgggagaacggcttgaacccaggaggcagagcttgcagtgagcccagatcgcaccactgcactccagcctgggcaacagaggaagactctgtctcaaaaaaaaaaaaaaaaaaaaaagaatttctgctctggtaagttgtacctcactgtgtctgctgtctgtctgtccagttttgggggcagtggttcatcctgtgatgtcacttcgctgacagactaagaagtgtttttttttttttttttctcctccagtttgttcagctttttacttgttaaaacagagtggcaactcctaagctctttacatgccaggccagaactggaagtcagtttatttatttttataacttgtagagtatttcattgtataactgtaccacaatgtattcattttcttattggtgaatattgcatcagtctaggcccaatcaggagacagataacagacaagcgattttaaaaagttttaataaaagtaatacaaactatgacaataagagcctaacttccataggctaccatagagctgaaggagagttctcaaggaagaactaacttggaaggaggattctctaggctggattcaggacttgttgtagttgcagcccactggatgtagttgcagcccactggatggcagagatgttttctggtttgcccagaccaaagctggtccacagttactcagcaatcagggaatagccctctggagcacaggtgagtctcagccagtggtcaggcctagagagagaaagtagaggtgctgctgtgagcactttgtgtcctcaggaaggacgtgaaagacaaatcctgggggtcggggtgttgagcaagcaaacagagagagtcagtggggacaggcctggagcacacagtatctttgtaggtaaggctgtggaaaggtgtctgtgtgattggggcagagcaacccacatatccacgttcccacaccactgactgataatgcagttgctagaattagcaccaagagcctgttctttctgcagtgtgcctccaataccctctactgagaaagtttaacatcatgctcactgtagaggatagatgatgcttaaaggaattctcttctttatctcagagcaggtattgaaggattaatttgaagcttagtggcattaaattgataaccagcatagacatttagattgtttatacttttccactattatagtcatcaatgctacagaaacatccttcttcatattctttttgtatatatgtacacagactttttctggcatatatatggaggcatggaattgataagtcttggaataaactgtataaatttttaggagtaggatcaataggtcaggaggcatgcatattttaatgttgtttgttacatatcatctaattgattttacatgagtattctggaactaagagtgtgccttccataaaagcattcagtccctatcattcaaggtcaagctcaagccctagtgtcaagcaggaagatccagctgccaattccaggtgaggactcctgctgcatggaagatgactaagatcgtaataatgccagccgtcagtaggagtccacagacctcggcccactgcatcttctttgggtttgaagctgtcaaggaggactcaacattcagcacactggttggaacagcatttcactcacagaaaggacagatacaacaagatcagagtctgtgatgtgcaccagtggcaaagatcccattccatcctgtggtgggcagatacactggtggggctggccgtgtgccacatgccacacacacttaagcaatacaaagaagtttactccatacccagaagaggggaaaagtttctgctaataaggaagaagaatctgtggccaagtgacagcttgccacacagcttccttatgagggaaagttttagacccaggccactaattgggtagtcttggagaggggtggcaggtcatgtgacggctacatcccttacagccagtaatccatccctctttactccctgacacgtatagactcctcacctctatctgcattgaatctatttgggctaatttcattatcccttactcctgtttatgcccattgccacaggaaccctcaggttacccgcaccccatcatctacatgcttaattcatctaaacctctgaacattccctgctctgtcttatccctccctgactctggaaacccttccagtgtaccttttggaattccagttctttatcagcaagatctgtctcgtaatctgttctctaaacattctttcttcttcctgttctagtggaatcataggggaagagggagagcttagaacactgattatctgcagactactcaagtgttaacccttttctcataatctcaaagcattgggtctagtagtaagggtagatgtcctctgttttttcattattttcactgtcttctccctaatctccccaaacttagaatcttacatatcattaatttgtatcatttagtacctatcattgcagctgtaaaactcttcatacattgcaattgtaaaaattttagctcttgactccaattactctcttcagttctactcctgtattattctttttttcagtctgtttgtgagctgtaatgtgttattcttggtggtttcgatacacccgtagttgataactccagttcttaagactttctgttctttgaactcctgtcttccagtgaacctctccactaccctacctcaatcacttatgccctagatctgtactttagaccttgtctccataatttcagtttccttcttcctgctctctgagcaccacctctaatctttctatagcttgtgtcatctagaaaccccacctttgaaaaacagtcatttgatcctgggacctttaatccttgggaaccttcgataactatattgagatgtcttccagacatctgtgtgaataattcagtatgtttgtcttgatttcaaggaaaaaatagggctagagatacaaatgttggactttcaccatataaaaagatcttaaatctgtgtgtctagatgtcatcacctagggagtgaacatagacagaaaggactaaaggtacaaggactgaaccctgggacattccagttttcagagaccaaaagaatgaggagagacccaaaaggaaagaggaaaacttagaatatatagtgtcctggaaaccacataaaaagagtatttcagaaatagcatgtgatcacctgagccaaatgatatagacagatcaagtgacatgaagtctgagtattgccagtgggatgtagcaatgtaatgtcagtgttgacattgattagctgttttgatggaatggtgggggcaaaacctaattggtgagtcaagaaagaaagggaaaaagaaaatggagataataactaaataatttgtcaaggagttttgctgttagagcagaaatgaaatgcaaagatgggtagagagatcaagagagttttcttatttgaaaaaagtaacagtgtctatgtacatacactgatggaagtgattcaacagcaagagaagatctgataatgcaagagaaaggagaatggctggcacagtgtccttctatagttgagaggggatgggatctagtaaataagcagtaggttagcctagctaggagcacaaacagtccttctctaggaataggggaggatgtggggaatacagtgcagattatggctgggtagatgtggtaaagatagcttattgaagttcttctctgattagttgaggccaggtgctgtggctcacgcctgtaatccccacacttcaggaggccaaggcgggagatcatgtcagcccagtagtttgagaccagcctaggcaacatggtgaaaccccatctctacaaatgatacaaaaattagctgggcatggtgttgcatacctgtagttccagctacttgggaggctgaggtgggaggatcatctgagtctgaggagttcgaggctgcagtgagctgtgattgcacggaactgtgattgtgattttgagaaagagcaagaccctgtctcaaaaaaatatttttttctcactaaaatggaaagtgaggtgattagctgagcctgaagagagaggataaagtatgatacagtcttttaaaaggatgggagaaagagtacactaagaagtatggtctgatttccagtagtatgaagagccaaagttagtgatcatacacataaagtgagactagtcagcttttctatatgactttctgaaacttctcaggctaggattttggaaagattgtgtgaagatactgaaattactcctgacagaaggcatgataaaaagaatgtgagtgatacaggaataaaatccttaaagagtgaaggggatttcccaaaggtttgtatgtgacttttagcaaggaggagtaatggttgttgtagtctgatgacatcatttcaaacctgggtgtttttatggagaacagagggagaatgcctgaagatgaaatgagccagcaggatgtctaccccacctctaggtctagtggtacaaagggcatgtgaaatccaacagccatcatttgagagagctgccaaggaagctgcatccacaggggacagtcaagttgcaacctgttcagggtatgttaagggctgtactaaatgtgtgtccagggtgcttgggagtacaaaagtaaagatttgtaacccaagctagtcattaagcaaggtgttctttttggaggtagctcattgaatgaggtagaaagctcattctaagatccgtatgaaatagaattatatgattaggaaattaacagtccacagcattatagttgcctggatacgatggctcactcctgtaattccaacactttgggaggccaaggtgggaggatcacttgaggtcaggagtttgagactagcctaggcaatatagtgagtccctgtctctccaaaaaaaaaaaaaaaaaaaaaaaaaagccaggtgtggtaatacacacttgtagtcccagctgctcagtaggctgaggtgggagggaggatcgcttgagtacaggaagtcacggctgcagtaagccgcggtcacgccactgcactgctctccagcctgtgaaacagagcaagactctgtctcaaaaaaaaaaaaaaaacacagaccataaaaaagtacagatcgtttgttactagattataaactgctaatcaaatatggatgggtaggcagaaagtcacggagggctatatgcagtgctaaagggatgaggtatgaggagtccatggcatggactcttttttacctaagatccatggaccctgagtggttttacaagtgccataaatcccctaaaattatattcccaattttgtatatatgttcattttcttgtggaggcaagatttgccaaaggtggttttttaatctaaaaactgaatactttttttttttttttgaaacagaatctctctctgttgcccaggctggagtgcagtggtgcaatttcggctcaccgcaacctccacctcctgggttcaagtgattcttgtgccttagcctcccaagtagctgggactgcaggtgtgcaccaccacacccagcaaatttttttttatttttagtagagacggggtatcaccatgttggccaggctgcttttgaactcctgacctcaggtgatccgcccacctcagcctcccaaattgctgggattacaggtgtgagccaccacacccggggaaaactaaatactctttaaggcttgaagaggcaaagtggtccgggcacagtgagtcacacttgtaatcccaacactttgggaggctgaggtgggcagatcacttgaggttaggaggtggagaccagcctggtcgacatgataaaaccccatctctattaaaaatacaaaaattatccaggcatagtggcacatgcctgtaatcccagctactcaggggccacaacatgtgagaagaatgcaaggaaaactctggaaacattaaaatcacattgttctagtggtgattacctgtggaaaaaagtaaaaaagcagctttaactttttattcaatttgctacggtttttggccataagaatttgtgaattgtacgataaaaatgttaaaataaaagttattaacagagggcagtgctggcagttggaagaccagttaagaggccattgccattatcaagatgttaggggaatgtttgaaataaagaaaatatatgactatgagaaaaatgtaagagattaaatcagtggcatgtggattgattgtcttcagattccctgagtgattaatgccatgtgttgatacccttaacttagataaggaatactaataggaagagaagagttagggggaggaagacgaacccaggatcaaatttacacgtattcagacacttgatttatgacaaaagtggcactatagagctgtaggcaaaatccattggatgtttgtatagagaaattggaaaacgtggctcttcacaagaaaatcaattccaggtgaattataattttaaatgtgaaaggtaatacagtaaaacttttagaaggtgtacagaagaaaatctgcatggccttaaaatagggaaattttttaaaaacaggatataaaggataagattcctaaatttgactacatttaaaatgaagaatttcaccgggcacgtggctcatgcctgtattcccagcactttgggaggccaaggcgggtggatcacctgaggtcaggagttcgagaccagcctggctgacatggtgaaacccggtctctactaaaaatacaaaaattagccaggcgtgctggcgggcgcctataatcccagctactcaggaggctgaggcaggagaatgggttgaacccgggaggtggaggttgcaatgagccgaggtggcgccattgcattccagcttgggcgacaagagggaaactctatctcaaacaaacaaacaaacaaacaaacaaaaaggccgggtgcagtggctcacgcctgtaatcccagcactttgggaggccgaggcgggcggatcacaaggtcaagagatcgagaccatcctggctaagacggtgaaaccccgtctctactaaaagtacaaaaaaattagccaagcatggtggcatgtgtctgtaatcccagctactcgggaggctgaggcaggagaatcgcttgaacccaggaggcggaggttgcagtgagtcaagatcgcgccactacactctagcctgagtgacagagcaagactcttgtctcaaaaaaaaaaaaaaaagttctggttatcaaaagatactatgaaaagagtgaaacgagaagccacaaggtgcgagaagataatgtgacacataaaagtaacaaaggacttgggttcagaatatataaagaactcctggggccagcacaggtggctcctataatcctagcactgcgggagccttaggtgggcggatcacttgagccgaggagttcgagaccagcctgggcaacatagtgaaaccctatctcttatatttaaaaaacaaaaacaaaaaccacacaaaaaaacctgtacatcaataaaataaaaagatagtatgattgaaaaatggccaagggacttggacagttcacacaaaagagatccaagtggtcaataaatgcatgaaaagataatttactctcattagtaattatgaaaatgcaaaagaagctgggtgcggtggctcacgcctgtaatgccaaccttttgggagaccgaggtgggcagatcacttgaggccagaagttcaagaccagcctggccaacagggcaaaaccttgtccgtactaaaaatacaaaaaaattagctgggcatggtggcgcacacctgtaatcccagctactcaggaggccgaggcaaaagaattacttcaacctgggaggcagaggttgcagtgagcaaagatcacggcactgcactccagcctgggcaacagagcgagactctgtctcaaaaaagaaagaaagaaaatgcaaaataaaatcacaaaaagatattatatgaccaataatggcttaaagagtgacaaaaccaagtatagatgagtatgtgaaacagtaggaatccataagtgctgctggtgagtgtataaattaatacaactattttgcaaaacagcttggtgttttcttacgtaaagtacagaaacaagcaaactagaacacaaacggacacatattatataatctcatttctatgaaatgtccaggatacacaatttcatagaggcagaaagtagattagtagtagccaggggctcgtgtagatggaaatgaagagtgactgctaacactcgagtagagggaaatgaagagtgactgctaacaggtatagattcatttttgggcgataaaaatgttctggaattatataatggttatgattgcatagctttgtgaatatactaaaaacctctaaactgcacacttaagggtaaatgttacatgaaagttatatctcacttttaaaattgtatgagagaaaaactagagtgtttagagttgcatatttagttggtaaagctataaggaaatgattatcataatattgactttagatggggtaaagggaggggttttgatcaggagggattatgtggagggattttggaagatggcattgttaaacctagatggtgtttacacaggtgcttgctatataattatattcctttataactagttaaactgtataaatgaagcagctgattcaaggtcaactgactgctcccagttttgtttataacttgtttctctgggatgaatcatcacttacctttgaactgtctcctccagctgctaaaatcgattcttaaagtggaaaaagcctgcttgctaggctgctagattttctgtcagattttttgttttttttttttttttttggtcccattgagccagttattgccatccttaaggaaggattcttctcaataatgtcattttttctggagctagaaccgtgaatgtaagtcattaataacaatcagcttagctgggcacagtgactcacacctgtaatgtcaacacctggggaagccaaggtaggggaattgcttgagaccagcctggacaacatagtgagacccccatctcttccaaaaattaaaaaattatctggcttttccactttatgatggcttacacctgtagctcctgctcctcaggaggctgaggtgggaggatcatttaagcccaggagttttgaggctgcaatgagctatgcctgcaccactgcactcctgggtgacagaataagaccctacctgaaaccaaaacaaacaaaaaaaagtagctataaaaaagaatgaaatcactgatgcagctggaggctattgtcctaagttaattaaggcaggaacagaaaataaaatactgcatgttctcccttatatgtgggagctaaacagcgggttactcatggccataaagatggcaacaggccaggtgcaatggctcacgcctgtaatccagcactttgggaggccgaggcaggtggatcacttgaggtcaggagttcaagaccagcctcgccaacctggagaaaactcatctctactaaaaatacaaaaattagcctggtgtcatggcacacgcctgtaatcccagctactcaggaggctgaggcaggagagtcgcttgaacccaggagatggaggttgaaatcgccccactgcactccagcctgggcaacagagtgagactgtgtttccaaaaaaaaaaaaaaaaaaaaaaggcaacaaaagattggagactacttagagggggcaagagttgaaaaagtagctattgcgttctgtgctcactacatgattgatgagatcaatcgtaccccaaacctcagcatcacgcaatatacccaggtaataaacctgaaagtgtacccgctgaatctaaaataaaagttgaaattattttttatgtgaatttttaaagaatcagtttaaatattttcttcagaatgttttgttgtttttgcttttgtctttggagacaaggtcctgctttgtcacataggctgtagtgtagtggcatgatcacggctcattgcagcctcaacctgctgggctcaaacagtcctcccacctcagcctcccgattatctgtgactacatgtgcgcaccactatgcccaactaattttttaatttttttgtagagacaaagtctcactgtgttccccaggctggcctcaaactcctgagctgaagtgatcctcctgccttggcctcccaaagtgctagaattacaagtgtgagctaccatgctggcccagaatgttgttataacatcttaatcttccttcccccaaaataagaccagttcaaattgtaaccatccaatgggtcctccttgcccactgtccagatagagccaatttatcaaaacaggggaatttcaatagagaaagggtttaatatacgcagagctggccaaacaggagactggagttttattactgaaatcagcctcccccacatttctgaggctatggttttgttttgttttgttttgttttgagatggagtctcaaaaattgcactccagtgcccaggctggagtgcagtgacgcgatctcggctcactacaacctctgcctcccatgttcaaatgattctcccacctcagcctcctgagtagctggaattacaggtgtgcatcaccacacctggctaatatttgtagttttagtagagatgggatttcaccatgttggcccgtctggtctcaaactcctgacctcaggtgatccacctgccttggcctctcaaagtgctgggattacaggtgtgagccactgtacctggctgaggctagggttttttaaggatagtttggtgggcagggggctagggaatgggggaatgttgagtagttgagtcagggatgatgttatctataggagaatctgtgaggttaggaatcttgtggcctctggctgaataactcctgagccataatttttaaccttgtggccaatttgtcagttttaccgaagtggtctggtccccaatccttcagagggtattttcccagcaggagctgttaccttctttgtttcaaagtaaactaaattcctaccaaagttagttttggcctaagctcagaaatgtacaagggcagcttggaggttagaagcaagatggagttggttaggtcagatttctttcattgtcataatattcctagtcagatttttctcactgtcataattttggcaaaggcagtttcaaaattattgattttattctgtcaacaaactttaaaatggtggtaattttggcttttttttttttttgaaagagtcttgctctgttgcccaggctggagtgcagtggtatgatctcagctcaccgcaacctctacctccctggttcaagcaattcccctgcctcagcctcagcctcccgactagctgggattacaggtgcacaccaccacgcccagctaatttttttgtatttttagtagagacggagtttcaccatgtttgccagactggtcccaaactcctgacctcaggcaatctgcctgcctcggcctcccaaagtgctgggattagaggcgtgagccaccgcgcccggctgtaattttggccttttaaggtaaatgtatattggagaaatagagaaaacccaataaaagtagcacacatttttaggccttagcatctgtggtagaataaagaatttctgtgatctttggtccagatgtaggcacagagcctctgaaaaccttggaatttcctgaaacataggattgtcttgttataccagtgaggtgactcgtagtgggcccctggatagtttcaggttggggactgatcacaagaaagacaaaccacattattagaaggttgagatagaggccgggagattgagttcagtcatttagccaatcatttaatcaatcatgactatgtaatgaaaattaaaactctggacaaccttaagctcagtagagcttcctggttggtgaacacaggagggtgacactcccggattccacaaggagagggcacaggatctctacttcccctcccacacctcaccctgcctttgtgtatcctttataataaaactgtaataataagtatagtgcttctctgaattctattagttgttctagtaaattattgaatgtgggagggctgtgagtactccctgaacttgcagctagtcagccagatatgctggtggtcttggcccctccccctgccatccccacaaagacttatgactggtgttggaagtgcggcagtcttgttgaggactttgctcttaaactgtggggtctatgctaactctatatggatggcatcagagtttaattgcagtatacccaacttgaggtagtgtcagaatagcatcttctgaaaagtctgcagagcctggccagttggaaagaatgcttgtttattatattgttgcttgcagttggtgggaattcatcattacttccccttgcattacagatgccttttgccaaagatttccatcacatatatagtggtctgttttttgctattaccctggcaacaactccataacttggaaaccatttcttttctccaacgttggccatatttggtaatgtagaatgttgaattgtgaatcagctctaaaaatcctaataaataaatgaaccttaaaaattgattacttaataagtacagtatttaccttatttatataagagcaaagacttatcatatgatgcctttcattctggtaggtgtcaccaagaattcaatataagactcagaaaaagtctttgacttagaaggtgttgtaaactaagcacattctgatttcattatcatggccttatggaagccctcatcacttttcatttggcttatcgaagataccccctaactccttttccctctctattctgtccattctaaattttagagtaagacacttttttttttttttttgtctgagacaagatcttactctgttacccaggctggagtgcagtgacatgatcgcagctcactgcagcctctaccttccagggctcaagcagtcctcccacctcagcctcccaaatagctgggactacaggtgtgcaccaccaccctcagctaattttttttagtttttgtagagatggagtctcactattttgcttaggctggtcttaaactcctgaactccagaagtcctcccacagtgttaggattacaggcccaattttcttttacaaaatatgttccaaatatgccaactttttctgtgctaacaagtgatttttagtagtatactccctaggagatttgggataaggggcacaaacactctttttagggcgaaggtgatattttatcattgagtgcaaaggtagctacactttaaaagaaatttgtgccatgaaaaaagcaatttgaagatggacgtttagaaatgttaccatctatatgtgattttggttgaaaaatgttatgcctcctccaaaagctggtaagtctatcatttgaaaacattggaaatagaatgtttctaatcttccaaaagaaaggttcaatttttgatctattgtttaaaaatataaaactataatacctcttcattaggttccaagaaaaattgctgacattacagaagataaaaatttatcatcccttggagggaattgaaaaacaagtatcatgatttaataaatacagccaacaatgcacttcttccattgggagctacatgtctttgtgaggtttattttattttatttaatttttaattttttttttttttgagacagagtctcattctttcaactaggctacagtgcagtgacacaatcgtggctcactgcagcgttgacctcctgggctcaagtgatcttccacctcagcctcccaactaagtacgaccacagatgcacaccaccacacccagctaataattttttaaatttttgtagagacagagtcccactgtgttgttgcccaggctggtcttgaactcttggcctcaagtgatcctcctgcctcatcctcccaaagtactgagattacaggcaagaaccaccacccctggcctattttttatctataataaaagcaagtcaaaatctaaattaaaaaaccaaaccacagaagggtttagacctaagatttttaaaaataagagccatctgatcaggcacagtggctcccacctataatcccaacactttgggaggccaacgcgggaggattgcttgagcccaggagttcaagactgcaatgagctgtgattgagccactgtactccagcctgggtggcagagcaagaccctgtctcagaaaaaaaatccataaaaatgagtaaatgagtacataaatatgagctatcttcaatcacattgcattctaaatgaaaaggtaaaaaattttgtaccatgaatatgtaaggtatttaatatatttgttttacttatttatatttatttttaaacaaatgttactgtgataaaattgatatacagtattcaaagtataaaattagataaatttctctttttttgagacggagtttcactcttgttgcccaggctgaagtgcagtggcgtgatctcagctcattgcaacctccacctcccgggttcaaatgattttcattcatttgaatgaaacctcaacctcaacctcctgagaagctgggattacaggctcctgccactacatcctgctaatttttgtgtgtgtgtgtgttttttttttttagtagagaccaggtttcaccatgttgggcaggctagtcttgaactcctgacctcaggtgatccatccgccttggcttcccaaagtgctgggattacaggcgtgagccaccgcacccagccagctttcgacctatgtatacacatctgtgcagccatcatcacgatcaaaattgtgaatacatctgtcatctcctaaagtttccctaggtccttttgtaattacttgcaggcaaccactgatgtgctttttgtcactcatagattactttggattttgtagaattttatctaaatggagttatatagtatgtactgtgttttttgtctggcgtcttgtcctttgtatttccatatgaatttaaaaatcagattatcagacaggcagctggtatttttattgggattgtgctgaatctgtagatcagttaggagtgaattgacttcttaacaatatcaaatcttttaacccatgaacatgctttgtttctccacctatttagatcatctttaatttctctcaacatgttttctgaagttcttatgcctcttttgtcaaatttatcactaggtgttccatatttttatgcaattataagtggtattgttatttttcatttctatttacagtatgtataaatgtagttgattttgtatattgatcttttatcctgcagccttgctaactctcttattccagtagctttattgtagattctgttgtattttctggagatactcctgttgtccatgaagaaagacaacttgcctattccactgggctggaactcccagtataattttgaatagaaatggtaatcgtagatattcttgccttgttcctgatcttagagcattttgtctttactattaactgtggtgttagctctaagtttgtcatagataccctttatcaactgaagaatgtgtcctattcctagtttgctaaaagtttttatcaaaaattattattgaacttttgtcaaatgcattttctatgtctaatgagatgattatatgtttttttcttgattagcctactaatgtagtgacttatattgattgattttcagattttaagccaactagaattcctgagataaacgttacttggtcatgatgtatttgctcccacctcccattatttagagaatattcgtttatgccgggcacggtggctcatgcctgtaatcccagcactttgggaggccgaggcgggcggatcacgaggttaggagctgatcaagaccatcctagctaacacagtgaaaccccgtctctactaaaaatacaaaaaattatccaggtgtggtggcgggtgcctgtagtcccagctactcagaggctgaggcaggagaatggtgtgaacctgggaggcggagcttgcagtgagccgagattgcgccattgcactccagcctgggcgacacagagagactccgtctcaaaaaaaaaaaaaaaaaaaaagaatattcttttgtattagtctttttatatgttgttgtatttgatttgctgaaattttaatatgtatgcatctatattcataaggaatattagtctgtagttatcttataatatctttgtctggttttggtgtcagggtaatgctgacctcatagttatgaattgggaagtattccctcctcttcaattttctggaagtgtgtagaattgttactacttctgtcttatatgtttggcagaattgtccagtgaagcctctgaacctagaatttgtgggaaggttttaaattataaacttaattttgttaatagatataggattagttaggttatctgttactgagtgagctttggtagtgtatatctttcaaagaattttcagtctcctctaagttgtcaaattaattaacataaagttgtttacaataattgacaaagttgttctgataactgtagaatccatagaaatgtgacctttctcattcttgatgttggtaatttctattttgtctttttttttcctgattagtctatcattttaattttattgatctcaaaaacctgtgtatgttctttgttgggttttttggtttgttttttgagacagggtctgtcacccaggctggagtagggtggcacaaatatgactcactgaagcttcaacctcctgggctcaagcagtcttcccacttcagcctctcaagtagccaggaccacaggcacaccgccatacccagctaatttttaaattctttgtagagatggggtctcatcgtgttgcccaggctggtcttgaacctctggattcgagcaatcctcttgccttggcttcccaaagtgctggaattacaaacgttagccactatgcctggcgttgtgtatggttttatacattttctctcttgttttccagtggtttttttattaattgatttctactttggtctttatgattacctttcttctgggtttcatttgctcctcttttttaaatttcttaaggtagaaagtgagagcatttcttgtttttttttttttgattttttttttttttttttttttttggtttggtgttttttgttagagaccaagtctcactatgttgccccaactgatcttgaacttttgggttcaggtggtcctcccaccttggtctctcaaagtgctgggagttagtctttcctttctaatatagtgtagtgatataatttcctttctaatataatgtagtgatataattttccccctaagaactgctttagtggtatgacatgtgttttcatttttattaaaaagacatagtcttgctctgttgcccaggctgtagtgcagtagcctgatcatagcttactgcagcctcgacttcctgggcttaagcgatcctcctgcctcatcctcctaagtagctgggaccacagttgcctgccaccacacccagctaatttattttattttttgtagagacgtggtctggctatgttgcccaggatggtcttgaattcctagcctcaagggattcccacaccttggcgtcccaaagtgctaggattacaggcatgagccagcacacccagcctctaatttcccttttgatttcttctttgacccacaaattattcagaagtatattgtttagtttatgaatatttggggattttccagagatgtttctgttactgatttctaattctatttcattgtagtcagaaaacatattttatatgacttgaatccttttaaaatttattgagttttgttttatgactcagagtgtgatctttcttagcaaatgttcagtgttcacctgaaaagaatgtatattagtactgtttggtagtggtctgtaagtgtcaattatgtcaagtttgttggtagtgttgttcaagtgttctacatcctcactgatcttcccatttatttattcaatcatttatatcagtatgaactaataggtatttattatctagatcagactgtaatccattaatactttagtttttttgcttaagttgttccgttttggccatcaaggtcctttcagttggctcctttccccccttgacttagatcaatttggtggtttttgtttggttggttttggttttggtttgttgttgttttatcccttccttactatctgcgattataagatattccaggctcatgttgtatatttctgaccccagtcctagaatcagccgtttctccaagaggtctggatttttaaattggagaacagtattacaaatcaagatctgggttctaggaatgcttgtttctactggggtgtcctttttctagtccctcttagctgattgaccaaagacatatagtattagtatgtatactaacctgtgaatatacacatatctataaatattttatatgtaattgtctgtatttatattaaacatgaattcttcttgatgtctctggctccaattcaatatcacatggatcattctagcttcttcttccctttgctgatctgtaaatttccactccaacaatgagaaacctgggtcccatcatccaccatccatacacataaactactcagttccagtgtacgtgtatagcagtatcaaaattattaacccatactccttgagaaacaactttatcaagttgagttcagtacttacctgtagttcctttgatctttagtctaactgatttcattcatttccaaagtttcttacgtcagcacttttcccttcaccctcttcagtgatgttgtttcatacatttgtaatacagttagattctcttgtcatagtctgcattcttctctgggatcctctgatctcataagttatttttttttaatttgcctttagaggtgacaaaccaaggcttaaatttttttttcccttacattactctctaggttataaagttctgtatgttttgacaaatgcgtaatgtcacgtatctgccactacagtatcatacagagtagatttatttccctaaaatagtgcacagtacttcacctatttgtccctcatcatttcccgctggcaccattgattgttttactgtctccatagttatacctaccttttccaaaatgtcacaaggtcagaatcttatgacatatagcctttcaaattagtttctttcacttagcaatatgccttcaaggttcctgtcttttcgtaggtggatagcttgtttatttttatcactaaataatattccattgtatggatgtgccacagtatgtttatccatcatctattgaaggacatcttggttgcttccagttttgggcgatcacgaataaacttgctatacacattcatgttcaggtttttgtgtagacaagttttcaacccaagtaagtaattatttagagcaattgctggattgtgtgggaagactgtgtttagctttttagaaactgccaaactgtcttccaaagtggctgtaccattttgcattcctactaacaataacaagagttcctgttgttccccatcctttttagccattctaataggtatgtatgagtatccaattgtagttttaatttgcaatgtcctatgccaaatgatgttgagaatctttttatatacttgtttgctatctgtatatctttggtgaggtggctgttcagatcttttgctcatttttaaaattgggttgtttgttttcttgttgagatttaagagttctttacacatttgtcttttatcaagtatgtgggtttttggttttgttttgttttgggggttgggggttgggacttgacttttcttgtttgtttttgagacaaggtcttgctctgtcacccaggctggagttcagtggtgcagtcacagcccactacagcccaagctcaaatgatcctcccacctcagcctcctaagtagctgagaccaggtgcgttaggctgccacacacaactaatttttaaattttttgtagagacaagatctccctgtattgtccagactgatcttgaactcctgggctcaagcagtcctccatcttcagcctcccaaagtgctgggattacaggcatgagccaccatgcccagccaagtatgtgttttttacagatatttcctcctagtctatggtctgtctttttcattctcttaacagtatcttttgcagaagttcttaattttaatgcagtctagcttattaatgttttttttcatggttttgcttttggtttcatatcctaaaaattcatcgccaaacccaaggtcacctagattttgtcctatgttatcatatacaagttttatcgttttttgtttttacatttaggtaaatcttacattcggatcattttcatgacccattttgagttaatttttgtaaaaggttgtatctagattcatttttttgcatatgaacattcagttgttccagcaccattcgtcaatgagaatatatattttcttcattgaattgccagtgctcctttgtcatatatcagttgactatatttgtatgggtctgtttgtggagtctctgctttgttctgctgatttatgtatctgttcttccaccatgttgtcttgatcactatagctttatagtgagtcttgaggtcaggtaatatcagtcctctaaccttattcttcttcagtattgtattggttgtttaggttattttgcctttccatgtaaactttagaatcaatttgtcaatattcacaaactaacttgcttggattttgattgggattgcatttaatccgtagatcaaattgcttataattaacattttagtcatattgagtcttccattatgatcatgcaagtctcatttatttagatctttgatttctttcatcagagtttcgtaatttacagtgtatagattttcagtgtatttgttaaatttatatgtaggcatttcagtttttctgttaatggtattgtgtttttaatttcaaattctgattattcatttctggtataaagggacacaattgactttttaatattagcattgtatcctgcaaccttgttgtaattgcttattagttacaggattgttgtttgttgattctttagaatattctacatagacaatcatgtcatctctaaacataaacacctttatttcctccttcccaatgtatttaccttttatttccttttcttgcctttttggttttgttttgctttttaatttatgtattttttttagaaatggggtctcactatgttgcccaggctggtcttgaactcctgggctcaagtaatccccccaactcagcctccgaaagtgccaggattacaagtatgagccactgcacccagtcgtcttttcttgccttattgcactggctaagacttccagtatgatactgaataggagtagtgagaggccatccttgccttgttcctgttcttggagaaaaaatacccggattctccccatgaagtattatgttaacaacaagtatgtcttctgtagatgttcttggtcaagtgaggaagttctcctgtattcctagtttgctgagtttttatcaaaaaagttttaaatgggttttagatttagtcaagtgctttttctgtatcagttgatgtgaccatatgatttttcttctttagtatgttgatgtggtaggtaattgattttcaaatgttgagccatccttgcatacttggagtaaattctatttggtgatggtatataacttttttatacattgttggatttgatatttctaatattgagaatttttgcatctgttttcataagaggtattggtctgtagtgtttttttcttacaatatctttatttggtttgggtaatagagtaatactggccccatggaatgagttaggaatcatgttacaatcatctttgcttggaagagattgtagagaattggtatcatttcttctataaatgtttggtagaattaatcagtgaaacatctgaaacaggtgctttttttggagatgattagctattgactcagtttctttaatggagtctttctttttttaaaattcaatctaacaagctctaccttttaattggggcatttaatgtggttgttgatgtggtttgtttatgtctaccacctccctatttgtttcctaattattccacctgtttttttctccttccgtgatcttttgctgctttatttggggttaagtgtgtatttttattccatttatgtcctttattggcttataggctataaccctttattgtttagtgtttgccttagcatttatagtgtatatctttaacatatccctcatatcaatcttcaaataatattataccacttcacatacaggataagaatcttccatttctccccttccagcctttatatagttgttttcaaacttttgatcctcatgtgttgtaaatcccacactattatttaatagtaataatattattattaattaaacatttactgctttttaaagagatttaaataataagaaaatgtcatgcatctttttccatgtagttaagtttcccattgctcttcattcttttgtgcagatccatatttccacctggcatcctttgcttctgcctaaaggacatttttaaaacatttttttgtagtgtggtttgctgttgagaattttatttagtttttttgtttgaaaaagtatttattttttacctctgtcttttaaaaatatttttgctgaggccgggagcagtggcttttgcctataatcccagcactttgggaggctgaggcagtaggattacttgaggtcaggagttcgagaccagcctggccaacatggtaaaataccgtctccattaaaaatagaaaaattagccaggcatggtggcgcgtgcctgtaatcccagttacttgggaggctaaggcaggagaatcttttgaacccaggaggcagagcttgcagtgagccaaggttgcgccattgcactcctgcctgagcaacaaaatgagactccatctcaaaaaaaaatttttttttgctggtacaatgacttctgacactaactatcccaaattaggccaaactttacaagggcccaggctgctacaaaactgccctcactttatacaccaagcagaagtttgggggttcccaggtcacccatacttctgacaaaatggatacaaatttgaggtttcttactacctcctgagttcagtaattcactagaatgattcacagagctcagaaaacccctatacttaggtttacaattttattgtggcaaaaaacataaaaatcaggtccggccaaagaaaacatgtgtaggacaaggtctgggagggtcccaacacaaagcttccagtgccttctccctgtgaagtcaggatgcatcaccctcctagcacatggatgtataacaatacatacaaattattattaagcagggaagctcacaggagctttgtgtccagagtgaggttttattttataagcatgattgattgactcattggccatatgactgaacttaatctctagcccctctccatttctgggaagtcaggtttatgtcagactgatagcaagtggctcaaagccctaaccctctttttttttttttttttttttttttgagaaggagtttcactctgctgcccagccaggctggagtgcagtggcatgatctcggctcactgcaacctccgcctcctaggttctaagcaattctcctggctcagcctcccaagtagctgggattacaggcatgtgccagcacagccggttaatttttgtatttttagtagagacgggattttgccacgttggccaggctggccttgaacccctaacctcaggcgatctgcctgcctcggcctcccaaagtgctaggtgagtgctagcactccctggtgctaggtgagcctcaaagccccaaccctccaattacatggttggtctttcaggtgtggccagtccccatcctgagttatatcattagcgtaaagtatcaggccctgtcataaataacaaaagcactcctatcacttgggaaattccaaggatttacaggctccttcccaggaactgggtactaaggccagtcaaattctttactacacaacagctgggtctagaattctaggttggcaggagaatagccatatcttccataattttttttttttttttgagacagagtctcgctttgtcacccaggctggagtacagtggcactgtctcggctcactgcaagctccacctcctgggttcacgccattctcctgcctcagccttccgaatatctgggactacaggcgcccgccaccacgcccggctaatttttttgtattttttagtagagacagggtttcattgtgttaaccaggatggtctcgatctcctggcctcgtgatccgcccacctcagcctcccaaagtgctgggattacgggcgtgagccaccacgcctggcccatatcttccataatttaaatatattgctctgctgtcttcttgcattgtttccaacgagaaatctgctataatccttgtctttgttcctctgtataacatatcttcttctcactttactgagctccaccaagctctagccactctaaagatttttctctgtatcttgagttttgagcgatttgactgggtattctttgatgtacttctcttcttctttctcatgtttgggattcttagagattcttagatttgtgatgttacaagaaaaacttgggactgcaacgtcccatctaaactgggaaggagccatgagaccaaagaatgactcagacaaatttaacttgatgagtagacgagtttattcaacttacatacaaggcactcctggacggcagcaggacagctctagagatccacgctgcctcctgtctctaaaccgcattttttgtttgtttgtttttagacatggggtgttttgccatgttgcttaggctggtctcagactcctggactcaagtgatcgccctcctcagcctcccaaactggcatgacaggcgtgagccactgtacccggctccctctaaactgcttttaagctaattttctggatctttgcctactgtgtttgaacaatgatactgtttttcttgagagattctcagatactctctgggatgtttggttggttctcagggatacctgctcctcagctgggtaccattgccatgggcctagccttcaggtttcaggcagtgaacatatgtacctttaagtaatctggtaaaggacccatcacacaacatgtgggtatatggtttttatcaaatttgcaaaatggtccgccattatttcttcctatcttttttctgtatcccctgctctcccctccccctgcttgaagttgtcctacagctcagtggtgctgtttatttagtttttttgctgcttttttttcccctctcggtgttagctatttctgacatacgtgtgtgttatgtaaccctagctgtactatgcgcacctggaagattctttgtacctctgtaaccagaccgatccttggaaggctggtcattgtaggatgctcatgtccaggcatctccttgaggctttagctgggtagttttgggaaccaacaaagggcatctgactttgcatgtcaagaatcaaactgtgggtatttgttaatctttgacatgagatgacactatcaaaaaagaacagaattttttttaaaaaaataagctttgatacttctgaggaggcctgatccttattaagtcctggctaaggaaacagctactcaggatcacttcccttatatcctggtgcccactagccagaagatggggagaggtcataacagatatccctgacacagagcatggaaaacccagagttcatgcaatgttgagagcagatccactggatgaagttgtatattttatgcacctgggggtgagaagaactgaaaatgcctcttattatttcaaccaaaaacaatgccattatataattgatacagaggtgctgctgcatagggtagtaggagcactgattgagaggctggtttctactagatcagtataaaaagacgttaagtgctatataagccctattggatagagatagtgggaaacaaaggggtaggtttttggcaacttggaacatccatacactgtgcaggaaacatactatccaagagaaagccagcgcatgttgaagtaccaggcccctgggaggtaagcacagaagtgaggaggtggacaggggttagaggggagccagcacagcatggagtatggtgcttacttcaacatggccttttgagtagagtcatattaacaactgccaacaaggggctcctacgtaccagtccccagctggaagatagcccagagaagtatggcaggcttaggtttaagaaccattgggattaatgcaaaggtaaacttacagttttgttcaaagcttctgagctttaagttagcaagttacagggaacacgtgaatactaattaagaaatggcggtatgctttgtagacttgggggccttgattacgaactatcttaaggtttactactatcctgagtccctacctgagaacttctctttccccttaaaacacacatgttcctggtttagcccttggatacagtgcgcagagatatatatgcaagaaacttttggattaggggtcctgttgccctttgagaaagtgtgaacatttggctataccctctgactgaatgagctctttaagccttctgaatgttggttcacttgacaaagacagattgaagtctcaggtgtgttcctaggagggcaggaaatagtcaagttgctgctagatctagaatggttatctgagagacatgggttgttacagcaaacttgggaacaagggagaaaacctctgggctatgaaacttttacagaaagagactcattaaactgatagtggccctgagaaaataaccatataattgccagtgctaggggaatatttcttgcccgaaagtcatgtccaccctcctcacaagcaaacctcacagagttttgtttcttttcccatccacaggtaacagtcctttggacagcccccggaatttctctccaaatgcacctgctcacttttcttttgttcctgcccgtaggtaagttgataggaaacctcctctgggaccagcacatgtggcacttgcatgagggttaattgaatgtcagattcctcctttaagtgtcactactctttcaagtgtattacctgaagctcccatccatcaaaactctgtctttgctttcctctcctaggttgtaatgatcgtgttctggttttgctttataggtgccccatgtatttgtgtttgaatgtttaaacaggagagtagatattaagtaaaagtagatttatttgtataattcacttttttttttaagtccctgatgtcctacgggtatgttccaaagcattatactctcaatttagaactgtcctacagtgatgaatgagaaaataagctctcctccaggaggacccaaagttatactctttgtcctctctaactcagctagtttaaagcagctgaaagggctctttgtgcctctctccttgactttgagctggagttcgtttgggggataaagacactacagggacttcacttttccttctatgaatttagaaagatttggtgcatacagagccatgcttacagtcctcctcccatgtttcttccctcttgagagtgataacaaacctgtctctggcccatggcagcaacgctgacagctctgcctgtggctggaatatcatcaggcctttagagaaagctgaatgagattaatccatccaaatcacatacctaggctctatacacacatgatttcttgtcagaacttttctaagattctttgccagagtttatatttattttattttattttttaatttttaaaattgttcttggttagagttagtccctggtataagacctccaggaaaattatggttccagatttgtaacctttaatggatggagaatgtaatatagctggagaccaggacagttttaatacttagactactttttttttttttttgagacggagtctcactctgtcacccaggctggagtgctgtggcatgatctcggctcactgcaaactccgcctcccgggttcacgccattctcctgcctcagcctcccgagtagctgggactacaggcgcccgccatcattccgagctaatttctttttttgtatttttgatagagacggggttccaccgtgttagccaggatggtcttgatctcctgacctcgtgatccacccgcctcggcctcccaaagtgctgggattacaggcatgagccaccgtgcccggcctacttagactactttttaaaaaaagacatattaggaaaaagagaggctcctggaaatggtgttaactcactattccaatgataacccaaaataaatccatcctctttccaggattctttgcagctgaaaagaacatgaacaggttgggataagtttgatagctgacgtgggtttcctccttcaacccacttaccttattcaaaacaaattttatccaggtttgttccacgggctcatctctcctaccctatggaacttccaatttgttaagcaaggatccagataagatcacttacagtataagaatatgctggtttgatgcatttgtttgtccaacccagctggaaagacttatcccagacttcttgcctggactatatataaactgtactctcagagtaggtacgagctgggacaccaagacctgtggctagatccccataggtggcattgagttatttctcattcatttgataaatatttgctgagcaccaccaactagagtcaggcgcactcggctgggtgcttagttatgtagtggtaacaaaatagacatagtccctacttccctgaaactcaggatgtaggagagtctgtgtactggttgtttcctctgtaaggaatgctgttccctcagatcttcatttagctaactcattgttatgattcatatctcatcttaaatgtcacctcctcagagaggccttccctaaacattcaatctaaaggggccttcttgtctttctccatcaaatcatccaattttattttcaaactagtacttttcaattcctgatattatcttatttgcatattttctgtctcaattcaaccacagtcaagtcacctttaatagagataccttcatttgttgaaagctgtgtcctggcgggaagacaaatgagtagtgggagagaaagacaaacaaatatatgtttataaattatgacaagcaccatagagggaaagagcatgatgctgcatgaaagaacaggaagagggccgggcacagtggctcacgcctgtaatcccagcactttgggaggccgaagcaggcatatcacttgaagtcgggagattgagaccagcctggccaacatggtgaaacaccatctctactaaaaatacaaaaattagccgggcatggtggtgcaggtctgtaatcctagctgctcgggaggctgaggcaggagaatcacttgaatccgggaggcagaggttgcagtgagccgagatcgtgccactgcactccagcctgggcgacagagcaagactccatctgaaacaaaacaaaacaaaaaaagaacaggaagagactaaagccagagaacctccactgggtggctatgtaaagcctctctgaaggatgagaagcagctgccatgttaggtgcgaggacccaggtgtgtgtagaccattccaggcagagggaacagcctgttccattgataccatgggtctgtttcattgcctgggtttaggagtaggaccaactaggaggcttcagggcctggttttttaccactgagacccaaacaggtctatgctaagtggcatgacatttgagtcatgtgcatggaacatggatctctgggctgtcctcttatacaacatagtaagaaaagctgctggttattggtgggatggggagaagtgtttcaaccctgccaaacagagtatcaggaatcgtttgtttctgtgttactggctggcgctttggaggatcacattggtttgcaatgtcaaacaaaagacagattgaattgaacactaaggatagacccattggtcctacaatttcacttcaaactatcacacattcctaaacagaaggaatgtgccaagctagaccaaataccaagattcaaaaagatcactctctctggttcctttggttctcactataatgtgtatttttttactacagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcagtaagtagccaaatctgtggccatacttccttcaccctaaggaagtacttccctttgggttatctagtgtcacaaaatggttctcaactttttctccaaagtcaaactcagagaggttgctgagagatgatgttgggtgcaacagagggctggggtcccttcccaaccatagccagctccataagtgccttcggaaaggatgaccagtgccctctctgggaatcagttacttctagtggaggcagaggagagcttgaggatgaacttttgctttgacagtgagaccagatatggggactcctaagcacacttcccctactcctccatccttatttctagaactggaaccaagagcagatcacctttctcatatctgaagcacttggtagactctcccctctttttcacctttttctttcaaaaaagaagggaagagtgattgttatttgatatccaagtttgatgcatatgaagcaaaaagctggacctgtctctaaaacgtttatttcttttggagaatgttttagcctaaaacacaagagctgtactaattgctgctatgcacaattgacccttaagccctcattgagcaacttttttttttttgaaagagtgtcactgtcacccaggctggagtgcagtggcgcaatcacggctcgctgcagcttcaacctccccaggctcagatgatcctcccacctcattctcctaagtagactgggactgcaggggcatgccaccaccctgtagcaggctaattttttgtagagagggggtttcatcatgtttcccaggctggtcccaaatttctgggctcaagcgatccatctgccttggcttcccaaagtgctaggattacaggcgtgaactgccacacccagccgagcaactttttattaaaaccacagtgacaaggttggccaactttttctgtaaagagcccaacgtggagtaaatgttttagtctttgaaggccatacagaagcaggccgtagacctgctgaccccatccccattacttgcagcattcttcaggtcttccctgctcagtgtgcctttattcctgaatctcgagcagggaaaaggagtacatttcctctcccaacctagatactactatcacattaatccaaagatgtcattggtctttggcaactgttaagtttaagatctttctctaataaacattccccttcccgggccaggcgcagtggctcacacctgtaatcctggcactttgggaggctgaggcaggctgatcgcaaggtcaggagatcgagaccatcgtggctaacatggtgaaaccccgtctccactaaaaatacaaaaaattagctgggcgtggtggtgggcgcctgtagtcccagcgtctcaggaggctgaggcaggagaatcgcttgaacccaggaggcggagattgccatgagccgagatcacaccactgcactccagcctgggtgacagagcaagactatctcaaaaaaaaaaaaaaaaaaaaaatcccctttcccataactcttcactcaaacaagtgatttttttagaaccaaggtaagtctcatctgcaaattttaagacttaactcattgctccagcttattaggattctttaaaataccagttttgcccactgtagtttacattgcctcactagtttcatgttagctatagctggtaagaatattttttgcaactttgatccaaatcatttattaaaatggggccaagaaataaccctgtggagacatctcactcgctgtttataacttcatgtattatagcattctatgagagaaaatgtgcactgttagcaaaaaagaaatgctgatttctcacttgtttattgagcctgtgacaacagagttatctcagtgtggtgctttagctttgattcttaaatggatttagatatttaaaccttggctctgggagcagtagctcaggcctataatctcagcactttgagaggtcaaagcaggagttccaaaagaccagcctggacaacacagcaagaccctgtcacttaaaaaaaaaatagctggacatggtggcatgcacctgcagtttcagctgcttgggaggctgaggcatgaggatcacttgagcccagaagtttgaggcagcagtgagctatgataacgccactgcactccagccaggacaacagaacagaatcctgtctctaaaaaaacaaacaggctgggcgcggtggctcacgcctgtaatcccagcactttgggaggccaaggcgggcagatcacctgaggtcgggagttccagaccagcctgaccaacgtggaaaaaccccatctttattaaaaatacaaaattacccgggcatggtggcacatgcctgtaatctcaactactcaggaggctgaggcaggagagtcacttgaacctgggaggcggaggttgcagtgagccaagatcgtgccattgcactccagcctgggcaacaagagcgaaactctgtctcaaaaaaaaaaaaaaaaccccagatcattgattagtttggtaaatagaacttgggctggccctgacttgcctgttctctttgtcagtcttgtcaggtaatggaggggggagttccctgatcctgggactgaatgggtgcttcagcattagctgcgcctgtagaagtcctgtgatagccgagcaccctccctcagatggcctgttgagattggcagtgctgttgtgaggaatcctcagtcactgagccatgtttagaattcatgagtgttttcaggtcaagcctaatcttcaggtccagatgtaaaagtaattttcttccctgctggattttcttgcctgctggacatcaggccatagttggtctgcaggctgtagtttgctaacccctggcacaatacattggccagcttgagtgagtctgggcacagccttcacagccccagcaaaggcacttctcctccagatagcagccaaaaggaaacattgctgagctgcccccagggtggctctctcaagattgtggaagggcgaacttaagaggatgttatttgcagctgggtacacctaaaacatgtcccaagtgaggaagcatgatttattaactacttttgcagctctaaaattccatgaaggtctgggcccaactccctgcacaacccttgaaggactccagtatattgaattcctcagggctgagggctctgaagggctggagaaaaacaggatcaagcacaggcaaggctaagggagtaggggaaagaagacctgctttgggtttatagtgactgggaagttccctgaccattttcagtccttccccattcttggactgctctgggacatgtctttaatgccacttcttaatgttttcccctctagtcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcaggtgagggtgctctctgcccactgttccagtgcatgtggatttcagcttgtttgcataacacagaggtgggcacactatgctataaggggccaagatagtaaatatttttaggctttataggccatatatctctgtcacattcctcaactctgctgttgtagtatgaaagtatccacaaataatatataaactttatttacaaaagaaaaaaaaaaagtagcaggccatagttagtctgcaggctgtaatttgctaacccctggcataatacattggccagcttgagtgagtcaagttcaacaaagcccaagctatttttggcttcaggtacagctcaacccatcaccccaggaggtatttaacaatactgtcaagtggtccctctctttttctgtttaaaggtagttagcagcagaaatatactttagattacatctggtaaaaggagaacaatggtatcatcaattctgatggttatctggctccagaacccattggccctgggtgtatgatctaggccagctaaaaaagttgctgctgaagacaggttgctggcgtggggaagaagcccatttcaaaagcagaattaaatgtccatttgaatatgtctttattctgtgaatcacctgggcacatcttcatcaaaccaaactaaccttaacagctgctgattaattttcgattctctttggcattagctggtaaatcagtgccagaattttaggttaaggaaggtgatggagattaaaatgaacatgactttaatgactgagctcagttttgcagggtccctaagaagtaattaattggctaagatgtgcagggtaggatcccagaggagcagcagttcctcccagaaagaatcccctcaggtaatgctggcactgcaccaggagtgacagggagtaagctgggccagaccacaatgactggttcaggtgtagagattgatgaagatggtatctgaggctccagtgcctttctctgtgtcacagaggaacacctgagtcttggtgttctcaacaacccatacacagagaagggtaccttttaggccagttgagattgagaggcccacagtgatgctcagagaaatccatgctatattactcttaaatccttggtaatgtgcagcagtacagcaggcaaaacatggcacattccagggaagaaagacagagtgggacagttgtgaacctagaacatctgggatcatgtgtcaggggcagtaaactgggcaagacccacatacccattcaactgtgtggctccaactttgaaatttttttaaggagatacaatgacacatgagccagagggggagatttaggttatcagggaagacaataaattaaggcagaaaacatatcggctgccttcagtaaatcacccagatgtataactcacaacagtctggactggcctcattcatccccaagttaggtccatggctgcagctagtttggaaaaaaaatgtacgtgtgcaccgtcttcctttggttgctttggtagtttttttatttgttttgttcccaagaatatgctggggcacacccaaccctattgaccaaaactaagaagacacagagaatcctactccaggggagtttatcctgggaaagccaccagtgagcttaggagtaggtccctttctaggtctttctagcctagaagaggtctttgtgaaaaccaagcctagctccatatagtaccattttgaactgaacaaggtacactggaaactccaggaataagaaaggctctagaactcagtacccgttaaagtgggagtatgtagctgctgaagatggtgggaggggcagggtctctggggatggccatctttcttcttgatagttccatagcactaaagtaacacaatcatttctttcttttttagtcccggacgatccccagtatcctttgacagtgaaataataatgatgaatcatgtttacaaagaaagattcccaaaggtaaggatccatttaaaaggagagtggcaatacccctccgggtggctgcctacagccagccccaatgggagactctggagtgaaggaatgaagtgctacctccagagataaccaagaagaagaacagaaagtcagccaggaggctgtggacacagcaacaagggcttccagactgcttgagaaggagacagcaggaagctatgagtttgggaactgtatttgcagagcctttgtttcttcactacccagaagtagagttatccagaggggaatgtcagaaaggtagcccaccatatattaaagaggaaagaaagaactggaggctttacttctcactgtgcacatgaggatccatgagtcagggttcactcattacaggatttgccctctggtggcatattcatttgatagagatttcttaagcagcacctcattatcaggtgtcagagagtacacagacagaagtaggctgcactggcaagaaggccagagagagcagtaggagtgggagacagatctcagagttgcttgctaacatctgaattttcattttcaagcaggaaaatgctgaggaaggaaagtaggttgttatcctgagatagctgagaagtagcattcgtaactctgctgcttggctgtgaacctccttgtatatggaactaggatcttgtttcccatttgcatgtctctttttttgttaagagatggagtcttgctctgtcacccaggctggagtgcaatggcaccatctcggctcactgcaccctctgcctccggggttcagacaattctcctgcctcagcctcccgagatgctgggactacaggcatgcgccaccacgcccggctaatttttgtatttttagtagagatgggttttgccatgttggccaggctggtctcgaaatcctgacctcaggtgatccacctgcctcagcctcccaaagtgctgggattacaggcatgagccagccactgtacctggccccatttgcatgtccttttcaacaccacatgcctgtacgctctgacctggcctcctgaagataggccctgttcctgactgagaggggatactggactgcagaacctgtgccctgtggtctgtgctttccagctttggagtgggcactagacaataagcatgaagaaggaggcagaacaaacacctagcaattcattttgacgtatatggtgtttatgaagtttgcaagtatataatgttgagaaatgtatctcatgcttgtcctcctcctccttgtatgttaggtgtttttgtagcattggatgtttgtgtttataggcatgtttccagttccttcctataggatgaactattgttggagaaaatgtgttaagattccttcacttccttctttctcctctactcccactttttcaccctcttcctctttcattctccatgtagacacaccacatatatatgtatgtaggtatacatttgcctaaacacacactggaaatcagaaatcaccacctggtagcaaaagaaataaggcagagtcttagatagacagcttagataggcagctaagaactcgttcacagatgtgtatctgtcattttgacatgactgtgtagttaggtccctaagaggtttggagccagacctccattctcctctgctggggatccaggccaggctcatgttcctatccacagtccccccattccaactcaccatctgtgaccagacaggttcactaagcagctctccaagcacctgcctaactcccttgggtcctaaggttaagtaagaggatcctgagttaaatgaaactctctctcacttaacaaacttcccggtttagaaaccagcagtgcccatacactaagtttacacagttgggaggtccagtggaagaacagaggaatggaaacccatttgcctggggaaatgaaagacttcccagaggagacacaatatttgaactgagattagaaggagaattaggagtttgtcaggcaggcttggcagggtgaaaaagccacacactgggaagagcataaacagacaggcatgaaacagcatagtaaaggaggaagatagcaaacacctgtgtgtccgtacagcaaaagagcttgccctggagggagttgggggagatgggcaagaccaggtgaaagagggccttgaatataaagctaaggcatcttgagttgactttacttgaaggtgatctattaatgtcttcagttatcaggtttcccaaatggcagtttaaggaaaccaggatcagagggagcccattattttgctatttccaggtccttcaggcttagctccaactgagctggaactagaagggaagtgtttctttcttgcttttcttcccaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagataatttggagaaacttttacaagatgtgagtgtccttgtgctggggttctgaaaaaacctccacctggtattggatttgtaatcccaagctaagattagggcattagtggtattctcagtcttcacagactgcttgttacccaccctcaaaggtagagctgagggacttagattcctcctcagtcccctgcaatactgagagaagcctgcttggtatcaaaggaagtcacttctgttccttttctaaatccaaaattatattactttgttgtattacgcgaagctccaccatgggtagtagtcataagtatttgactaggaggtttgctacccaaagccaaaaagtggctccagtggctgtgacgggctttcttctactggaaatactggtttaagcagagccttcagactatttatcctcagccaagggaaaacaggtatgaggcttgcacaatgggtttagccatttgcatggtgagaagttctctagttgggacttacatgttttgagacctggtcctcgctggtgtgaaaaaatctctgggaggctaaaggtaaagtaatccagagatggccaagaccaaagcacatgagagttcttaagcactgcttcctgcacgagtgcttcctttgctatcagcctcttgattaaggtggccagatgccatctcactcagaccacagcggctccatgttatccattaatacagtttgggagagagaggatatgcctgtccccgcagagctcatcacatcactagagaatttcccagtccagaaccccttattacctccagaccaagacctctctctctggagtagtaccaactgagctgagggcccagggctaatgatcaaaaggacatcagtgtgttcgtctagaaataagaaggagcagggagtttaaacaaattttcagagaacagttgaatctagagaaagggtgactaaagatgatcatgattattgttgtcaagtagtagaaagtttctcacatataaaagagagcagattgttcttaatacccctgaaagacataattagtccagtgggcagaagttacagtgagaaaggttttgatttaataggtgaaaaagtagttccttctacaaaaatacctttttgtgatttcaaaagaaatacttaaaataaaacattgtagaagtataactttagaaagccagagtcccatgaaaatcactggtagctgtttgtttctgttcaagaaaaggtttctgacagttttccagcaatggaaaggggtaccccagagacatataggaatcagggattactgcatcaggtaaaggattaatgtagagtaacttccaagtttcctggtatgtttaagatttatcttctaaaatgctaaagtcagagccttgcccaaaacctttaggcattttcccagattgactgcttgtgtggttaggttgtttgatacaataggaagagcactgaatttggagccagtttgttcatctgttccctaatttgtgaagcccttggaatgcagaaaagaattcagtgcaggctctatcttagggaatttgccatcagtgaggttacagacccatcaacatgtacttaataaaaataagttattactatactgaatactttatatgaattctctcacttccactgactgcaatacaatgtgattgacgagcactagagataagtaggttctgagcacagaggaggatatgctgactctttgtggaaagttcagggaaggctagatcttaacaggtaggagttcactgaagctagaaaacagcataaacaaccttttgcttgggcacagtggctcatgcctgtaatcccagcactttgggaggccaggatggaaggatcacttgagcccaggagcttgagaccagcctgagcaacaaagtgagaccccatctctacactagccaggcatttcaccatgttggccaggctggtctcaaactcctgacctcaagtgatcgccctgcctcggcctctcaaagtgctgggattacaggtgtgagctgctacaaatgaccagctggcagatgaatttgaagagttggactgggggccagatgctgaacggccttgtgaggagcttagattgtatcgtgaaggcagtgggtatcatccaatgtgacaaattgaaaaatgacctgatcagattttagaataataaaagtcagtaacatttatggagcatttaatacatgctagacactgcattacctcatttaatttatctggttaaatcttcacaaccgtgtaagaaaggtacttaatattatttcctaaatttacagataaggaaactaagttagctcaagataactgatttttttaagtagcaaaaccaggacccaacccagatttggcttattccagagcctaagatcatacattttcaaacagtcaacaaacattgactgacatctgctgtataggaggcattctgctaggcttagcatttgaggaaagaaacagggccaggtgcggtggctcactcctgtaatcccagcactttgggaggctgaggcaggcagatcacctgaggtcgggagttccagaccagcctgatcaacatggagaaaacccatctctactaaaaatacaaaattagctgagcatggtgacgcacgcctgtaatcccagccgctcgggaggctgaggcaggagaatcgcttgaactcagtaggtggaggttgcggtgagccaagatcatgccattgtactccagcctgggcaataaaagtgaaactctgtctcaaaaaaaaaaaaaagaaaagaaaaagacacagagcctctttactcactaggcccagcagtgtagctgtagagacagacagctcattatgaaacagcatgacagtaccatgtggtatgcatgaacagccaagagaacatgttaaagacagcaattctttttcttctcgtgtgtgtgtatatgtgtgttgggaacaggagacaggttttaaaagaataaatgggatttcaccaactgctcaacctttctcttcatttcataaccaatactttaaaagaagaaaagtcctcatttactgtgttttttttccgaagaaaaataattttaaaataatttgtaagcaaaaataatcctaattaggcattcatgggaagatatttaggaaaatgtggtacaatttgaaaataatagccattagaatctaagatattattggtaattatatcttcgttttcattgatttttaatactatttaatttgattatgtatttttcttttttttattattattatactttaagttttagggtacatgtgcacaatgtgcaggttagttacatatgtatacatgtgccatgctggtgtgctgcaccaattaactcatcatttagcattaggtatatctcctaatgctatccctcccccctccccccaccccacaacagtccccagagtgtgatgttccccttcctgtgtccatgtgtcctcattgttcaattcccacctatgagtgagaatatgcggtgtttggttttttgttcttgcgatagtttactgggaatgatgatttccaatttcatccatgtccctacaaaggacatgaactcatcattttttgtggctgcatagtattccatggtgtatatgtgccacattttcttaatccagtctatcattgttggacatttgggttggttaagggatcaattcaacaagaagagctaactatcctaaatatatatgcacccaatacaggagcacccagtttcataaagcaagtcctgagtgacctacaaagagacttagactcccacacaataataatgggagactttaacaccccactgtcaacattagacagatcagcgtgacagaaagttagcaaggatacccaggaattgaactcagctctccaccaagcggacctaatagacatctacagaaccctccaccccaaatcaacagaatatacatttttttcagcaccgcatcacacctattccaaaattgaccacatagttggaagtaaagctctcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaacacattcaaaagctagcagaaggcaagaaataactaaaatcagagcagaactgacggaaatagagacacaaaaaacccttcaaaaaattaatgaatccaggagctggttttttgaaaggatcaacaaaattgatagaccgctaccaagactaataaagaagaaaagagagaagaatcaaataggcacaataaaaagtgataaaggggatatcaccaccaatcccacagaaatacaaactaccatcagagaatactacaaacatctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaattggtaccattccttctgaaactattccaatcaatagaaaaagagggaatcctccctaactcattttatgatgccagcatcatcctgataccaaagccgggcagagacacaactaaaaaagagaattttagaccaatatccttgatgaacattgatgcaaaaatcctcaataaaatactggcaaaccgaatccagtagtacatcaaaaagcttatccaccatgatcaagtgggcttcatccctgggatgcaaggctggttcaatatacataaatcaataaatgtaatccagcatataaacagaaccaaagacaaaaaccacatgattatctcaatagatgcagaaaaggcctttgacaaaattcaacaacccttcatgctaaaaactctcagtaaattaggtattgatgggatgtatctcaaaataataagagctatctatgacaaacccacagccaatatcatactgaattgaatgggcaaaaactggaagcattccctttgaaaactgccacaagacagggatgccctctctgaccactcctattcaacatagttttggaagttctggccagggcaatgaggcaggagaaggaaataaagggtattcaattaggaaaagaggaagtcaaattgtccctgtttccagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccaacttacaagggacgtgaaggacctcttcaaggagaactacaaaccactgctcagtgaaataggatacaaacaaatggaagagcattccatgctcatgggtaggaagaatcaatatcgtgaaaatggccatactgcccaaggtaatttttatagattcaacaccatccccatcaagctaccaatgactttcttcacagaattagaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgctgcatatctacaactatctgatctttgacaaacctgagaaaaataagcaatggggaaaggattccctatttaataaatggtgctgagaaaactggctagccatatgtagaaagctgaaattggatcccttccgtacaccttatataaaaattaattcaagatggattaaagacttaaacgttagacctaaaaccataaaaaccctagaagaaaacctaggcattaccattcaggacataggcttgggcaaggacttcatgtctaaagcaccaaaagcaatggcaacaaaagccaaaattgacaaatgggatctaattaaacgaaagagctgctgcacagcaaaagaaactaccatcagagggaacaggcaacctacaaaatgggagaaaattttcgcaacctactcatctgacaaagggctaatatccagaatctacaatgaactcaaatttacaagaaaaaaacaaccccatcaaaaagtgggcgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtggggcgattcctcagggatctagaactagaaataccatttgacccagccatcccattactgggtatatacccaaaggactataaatcatgctgctataaagacacatgcacacgtatgtttattgcggcactattcacaatagcatttactgtttttctttccttgtatcctatttactactcaatcttctgccttccagtttcccttcccaccagtctaccaaaactgttcaggcaaaattcaccaaggaactcactggccaattgccaaatcctgtggccactttcagttcccatcttctgccacctctcggtggagcacagtgaatacttcctaaacttccttccccagttgtcaattcactgttctcaccactcttgctgcctcttcacaagttcctttgctgcccacctcttcctactggtgtgtcacagggcaccatccggcatgcctggtctcccctttctctttcctccactctctctctgatgtcttgccacctgctcccatgtcttcagttgtcatctctacgctgaggactcccacatgtggctgccactcttactgttctcctgagcttcagatcagtgcacccagctgcctgctggactcctccactttgacttccctatattggttcttattctttggttgcacgtaatagaaactgattcagaatagtttaaacagtaaagggaaacattataagagtaaaaggagtaggtcttagagaattgaagcgagggatataaccaggccttaagaaggaaccagaactagaaaccagaagctccaggaagctcaggaagtcttcattcttcctttttctgtatgcatcttttcctctatttccatggtaggtatgcatctcttttcacagttcttaaacggttctgccacactgacgttaacagttgtctttctatccttttttaaattcctaggaaagtgatcctctctggtcagctattagaggtgggagggaaggtacagacacacagtacaaatgtggctcctagaaaccagagcagttctcaggaaaaaagagaaaggcccatcggccaagcagatacccaagagactctcatataggtgcctgaaactgcacgcccagaactgagcttatcttttctgcctagctgttctttctctaaaaccaaatgcagtacattctttacctatcacctaaatggcttcttatagttactatttcacttattcattgtaattttcctaaaattgaagttgtagttgccttctgtcgtgcttctttcaccccttatctgcttctgtagtaacccacgtctatccccttgtctgcattcttctgccttgacctatgcctttttcatctgaattattagagttgcctgctaatgggttttcctgcatttagccttgccctctttagtgtactctctacactgcagccagagtgatccttctgaagtactttctggtcatatgactcctcagctttgaggtctttctactccttacagtctagggtggaaagtgaacatcagtgaaggcaccattgagagctgccccttgagctagggtctggagggtaagtgaggcttgttggatggaggagcaggtacagctgtatgtctgtgtggcatttcttggtgtcatgtagtgttctaaagcagaaatggttccctatgagcaactcgctccctctcacagccagccagccttctctgagttccttgctttgcggagctctctatgctaccgaattgtttctccctggagtcagctctgccctgtctggtcctgcttagcccagccacactgggccaatagattaagcaacgcttcttttctctataggctcatgagcgctcagagagctcagaagtggcttttgtgatgcagctggtgaaaaagctgatgattatcattgcccgcccagcacgtctcctggaatgcctggtgagtggactctaggaaagtcaggtgggcagatttagaggaggactatagaggaagtatcctgatgacagcaaaactgtggtggtaaccactgccatttctgttgcttaggtccttatttaaatatgatttgccaccattgggggactaaacaggtttttgtgaggacaaatgtatggtcctgaggggatgcggcagggagaattattagtctaggccacccccacatgagcagggctcacatcagtgggggtcttgggggtgagaagcgtcaggagcatagcccagtttagtttgtacaagttgagtccttcattttatcttcagcaatacttgactgagtacctacttcctgctagacactggagatacagacatgaataaagcacagtctctgatcttgggatgtttcctctacagtggagttgggaagcatgaggcatgaggacatgtaaatagtaattacaatactgcaagaagtgttgcagttgaggtcagtacacagcgtaacgggaacctggaaaaggaagtgctttagtcttccctggaaggaacattcagtgaatgctccctgggggacgtgaggcttattcagcaaactgaaggatgagtctaagtttcccagatcgggagcatgggaaggagcattcagtggggcacagggtgggtttgaagaagtgctgaggggtaagcctggaaggtaggctgtgacagggtcatggagggtgtcgggttctcggctctggagtttttcattacccttacggccacttggagacaccagaaagtttaggtaagaatgtgacatggccgcatttacttttttcttaaaaaatattattaaggtataattttcatacaataaaatatatccctttgatggtacagttcattgagatttaacaaatacacacttgtagaatcgtggccacagctgacatagagaatatttctgtcatataagttcccttgtgcccctttgaagtcagtcctctcttcctcctgctcccagacaataacttaactgctttgtttcactagggatgggtttgccttttgtacagtttcctagaaatgaaaccatgtttctgtgtggtttctgtagtatgttctgaattctttcactcagcatgtttgtagaaattcatacatgttgttgcatgtatcagtaattggttcctatttatttctgtgtaaatattacatcagatttagtcctaagaaagattactttggctgcaacatggatagtgaattggaagagagggcaggatgagccagggacatcaggggagaggtactcaaagcaaattcatgtgagatggggtggccagaactcagacagtgaatggtaggataatagagagaaagaggtggattagaggggtatttatgagagagacattctgaccaaataggagctaaggaaggataagaagttaaaaggacttccaggtctggcgtaggttatatccagataggtacagttctccaaaacagtgaggccacagggaatgagaacagagttcagggcagaggctatgctgtgatagagcagagagcctctccctcaggaacatgaagtccttggctaagcaggggcttggagtcagacctgggctgaatgctggttttctgttccttcctactactgtgattatggacaaatcagtgcatccctgaaagccttgatttcctcagtgaggtcaaagagttgctagagggtttaacccagtgtgtggcacttagtaggcactcagttattatgtgcagacaaggattgtgcttttcaatggatttccagcctctagcacataggaggtgcccagtaaatatttgaaggtatacatgcaccagtagggctttgccaaagctcttgtgagccataattgagtgtgtgccaggacagctgtggactgggcatctgaatacaccagacagtgccacctggctgatggaaagcatgggaccagatcaataggctgagctctctttagagtaaaacctctagttcttactgccaggaagacagcatatgcttagcatgtccaatctggaggtgacctgtaagacatctttgtccccattcctgtgatccctgaatcatgttgtttctgaatattcaggggtgggagtgtcctatcacagagaaagtcttgttcatctcagtctactatatgctgtaaaaccaaagatgccagcagctttcgcttatatctgtcaccactgactatctctctcccttggtacaggagtttgaccctgaagagttctaccaccttttagaagcagctgagggccacgccaaagagggacaagggattaaatgtgacattccccgctacatcgttagccagctgggcctcacccgggatcccctagaaggtgagcatgctgcctagtggctgcaaagaggccccactgctgctggcaagctctaacagcagggaagctgcttggaaaagagacttagcttggacatggacacaacatggccccgggggcctcaggattttaggagataccctgtgatctctgtgacaaaacagtctttactttggaactgctgttcacatctgcctgatagatcccaacctggattgcattggcccggctgagttgcatttagaacctcagttccaaagaggtcaacaacaaagggccacaatcacatttgcaaaaatggtcacctcctctgcaacttgcctctactcttggccaccttacaggtcttcctgtgtctttggggtagtccaacacagggcttcagaggatactgccattcttctgggcttcctgctgaacccctgcagcaaccatgggcttccaagtccctggtctgtaggtatcctgctcctgccttctgtgcttcccagccccatccagtgaagcagtcttggccagcaggatgggaactagtaacccagtttcaggccctgttttccaggaaatgtccccagtttatagaatttgccaggccctgtgaatggcaatggacttctggaaatgggagtagcagtaggatttggcttgtttcctgatccaaaagctgggactacattgggtatagtgccatgggactgaattcacatcctaggctgatgcaaaaagcattaatgactaccctacatgcacctgttgtgtgatctgaggatactgctgagatacctgacattgccacgcacattcttctcttgtatctttgtttccagaaatggcccagttgagcagctgtgacagtcctgacactccagagacagatgattctattgaggtaaaaaccctgagctcctaccccattcctggagcctgggccctatgaagcaaagagctatgaattctctttaagagaatatctgaggaagggatgggggagttggtgacagcaaacactgagaagtcattctactcccagaagaatgagcaggagactgcactagagctgacagctgagaagatgctagagccacagcttctgcaaggatatgggctctgagaagcatgcctgtctcctgccttttcccttgtcttccagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctctgagaatagaacagaagagcaacatggggcatagttctggagggaggcagcagctttgccagtttcccttccctctcaccttctcactgtgtgtacagcctccaaagatactgtgcctagtcttgaagctgaagctgaacaaaactgtcctttagtgtttactgggtacatgctgggagttcatagtgttactttactcagaaactaaaagccagtaagaaggaagtaacatgaacagatgttaacatctcagccagatgtgtttacagtatgcagtattcctgtcctaaaaaacattaggctggtacaaaagtaattgcatgtttgccattacttttaataaaggcctgggttccttccctctctggcctgaaaaatgtccatgacagctattagcagattcactttactttccacccccctccataccctgtgtattttcatgctgctaataaaggcataccagagactgggcaatttacaaaagaaagaggtttagtggacttacagttccatgtggctggggaggcctcacaatcatggcagaaggtgaaaggcatgtctcacatggcagcagacaagagagagcttgtgcagggaagctcccctttataaaaccatcagatgggccggacgtggtggctcatgcctgtaatcccagcactttgggaggctgagccaggtggatcacctgaggtcaggaatttgagaccagcctgaccaacatggcgaaaccccgtctctacaaaaaatgcaaaaattagctgggtgtggtggtgcacgcctgtgatcccagctactcgggaggctgaggcaggagaatcgcttgaacctgggaggcagaggttgcggtgagctgatatcacaccactgcactctagcctgggtgacagagcaagactttgcctcaaaaaaataaataaataaaaataaccatcagatctcatgagacttattcactatcacgagaatagcatgggaaagacccacttccatgattcagttatctccctccaggtcccttcccacaacacatgggaattatgggagctgcaattcaagatgagctatgggtggggacacagccaaaccatatcaccctgtctcccacccatgccagcagcaaaggggctagaatcagagtctccagcaccaggatattccatgaagctgtctcctctgggacctcagaaactgccagatgggagctggctagctagagcagggaactgaatcctttcctcatggtagcctgggcttgttgcagggggagactgtgccactctgctgaagaatattggggccctgcctgtggacatggtgcgtctatactttgcggaaactgtgctggccctggagtacttacacaactatggcatcgtgcaccgtgacctcaagcctgacaagtatgtccacagtctgtgtcccttgtccagggtctccctcttgggtctccagataaaatgttggcaagcacagtagctctaaatctatccagatggctaccgggaaaacatgctcctgtgtgtgtccatctgggcctagttctctagccccccgaccaccccagatgcagatcattgcctcaaggtctggctggaacactataaggcttcggtgacatggaagagtcattgaggagccccactgaagaaaccaagcaagaacaaaagaataagcacatctagtagatggctaaacaagtgtcctgacgtttactgacatctactctgtgccagcactatattgtgggtttttaaatgtagtccctggcatgtagaacttaagtctacagtgggagacagaaatatatgtatataggcttcttctcagagggtattagtcaagtggaaaaaggaagacctgctttctaaagcaggagagcagaatgtgcagagtcacacaggtgcaagagaacagcacttgttcaggaactacaaatagtgcaatatggcgacagcttagatggtgagagagtagtaagagaaaaggctagagagagaggcaggaactagttcatcaagggcccttttgttatatttgggttttattctaaaggggcctagagagtcttggaagggtctgctaaccaaagatatgatagaatggcatgcccagattatggttcaggtttagaaagctcactctgccggtgaaaagagacactgagaccactgccaaagagataccgagaccagggaaagacagcaatgcctgcagcagaacagggagtcaggatagaaagaagaggggtagtgtggggaagtataaaggaaagaggatcaggctggggtgggggtaggaagggaagtgagggaacagaagaggctgggatgtgttccagatttccagcttgggactggtgcagggtgataagcctctgtggaagaaagtggctttgacataagacagacctgaattcaaatggccactcttctgcttattaagtctgagtttgagtctactaattaaagtttccctgaccctcacgttcctcctttctaatatagggaataattacacctacctttgatgtgttactctagaaaacatttcaggggccagaatatttttaaagcacttagcacagagctcaacagataaccaaaattattgtttttcactgaggaggggaaccagttgggaggcatgactttgttttggacaggttgagtttctggagcctgtaagacacatgggcagttgggtaggcctggagctcaaaaaggaagtcagagccagaggtactatttggggaatcattagaataaaagggtggcagggtaaagccttcagcacaaaatgagtggctcaggcagagtatataaagggatcttagttctagtttctcccaactaaccctcctcccaagaccagccatggacatggaacaaaattatgtgtgccccctgcccctctccctgaaacaggagtattatgggccactcagattgggagaggggactaggaatggctccagcagctgccttaggatgaggctgatctcagctctgtagaagaaactctgttcctcaactgaatgactcctgcccccaacatagaatacagttagggcaataagcagaaatggagttgtgggaatgggcaaaaggcaggttcgttgcttgtgcagaatgcagcactcacacagccagagcgatttacgtgtccacacctgcctgtccccccagctgaagctacccagcttgtgtctcacagtacccccatggaagcctgagtggggaaactgggcatatactaaaatcagtactctcagaaaaccaggaataacttcttaattttatttcttcgttcttccagcctcctaattacatccatggggcacatcaagctcacggactttggactgtccaaaattggcctcatgagtctgacaacgaacttgtatgagggtcatattgaaaaggatgcccgggaattcctggacaagcaggtaaggaagggtagttgatacactgggggttaaattctaggcccttgtcctggcgcagtgtcttacgcccgtaatcccaaccctttgggaggctgaggcaggaggatcgcttgaggccagcctgggcaacatagtgagaccccatctctacatttgtgtacacatacatagattccaggccctagaataaggccttggggccatatgcctaccttgtagctagatgttaagattgggaacccctatcttttctacctttgggttccagagaggcactgagataggtagcacatttggaaaacaggatgagccttgagaatcatatggatataaaatccaaagtcatcttcctcctcagggtttggggaaaataggtcatataactgttagcacagagtttcatatgagatcagtcctgaatctcccagcctgaatcaagggcaaggctctcctggagcctgaggttcttggaacacagctctgaatttccattgggctgtggcccagtgtcctgagaggcagcctctggatgttccctggtttgacatttcaggttgtgactgttcaccggtccctgtagttgttacatgactgatagggtctgttttgttagaggctggagtgcagaggcccattgtgggatcacatgccagaggtgggtgttgagggcttaagggatggtagttccgggctagaatgagacatttttgttaattaggaaatacctactgacagttccgactcttgttccctggggcttctgttgatcttgttcattaactaaggtgggctgagtcttcattcagagattcttctgctcgagatgggagcatcccccatctccggctgtcatgccagtcagcagcctcaggaggctgagccagcctggcttttctgtgcccaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggtagggcaggccctgctaacttttctcactacttggaaaaggggtaagggaggctgagtcatgtaccctggaggttcaggcttcggttacgggcagcccctctggatcctgaaactctgccctgctctgtaggcagaaaagggaagatgcttgagctgatcccctaggtatagcttctgaaggtctggcttcttgctagatttgctgacctagactccatgctgctcatcctacccccttgcccatgtcctccctgtccacaggcagtgcctatgaggtgaagcagcacccattctttactggtctggactggacaggacttctccgccagaaggctgaatttattcctcagttggagtcagaggatgatactagctattttgacagtaaggccaccgatgggtggggtggaggatgggtcctacctgtttgcctagaaacacctgtgcacactgaaattgcattgggagcaacttctcagggctctgctgaaatctaatggggtcacaaggaggccaccagcagggctctgaaggaaagtgtcctttatgtctggcccagcccgctcagagcgataccaccacatggactcggaggatgaggaagaagtgagtgaggatggctgccttgagatccgccagttctcttcctgctctccaaggttcaacaaggtgtgactgaggaggcccagaatgggcagaacaggctggaggatcagaagaagagggcctgtcaaagggcacacctggggcaggctcagggagttggggttggggccacctctagaaaaagaggagctaagggttggggctacatatagctatatataggtgcttctagaaccactgctgtccctgacatgagatgccaggtcagatcagtggaataactccttccccaaatattcagcaggggtgtgtgaaggagggatggaaccgactggttcaaattcctaggtttccgatgccaaggatgctttatgccacttgggaggtacggctgccagagcccatccccagcgcatcccctgtgcccacaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatgtgagcacccagagttcacccagggtgggcgacacagctatccctgcattgtcacagatcatgggagagattccgatgccagggaggagtgcaggtggcagggagggggcattcacaagggtggctcctggaggaatgtctgcggaggaaagttctgttactataacccttgtgtgcccctaaggagacctggcaggaggagggggaccacctgggtcactcaccccaggccttgtgtctcatagattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccaggtatggcccagtgggcggccaaacgacctaagctggaggatactgcagggcagggaggctcagcggcatcgcgggtctcactgcttacttgggcctacagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcgggtgaggcccctggggagctgggataaaactcacaggaagggccttgtaatctctaggccttgggagggttctgcacgtggcaggtgtgtgtgtgtgtgttaagcacagatctgactgtggtctctgaaggtgtgtattggtgtctggggttgtgtatacatgtgccagaaagcaggacagcaccatgtcacaagtgcaggctttggggtagagagctcacactcaaatcctggctccatcactaacaggctcttgaccttgagcaagttgcttaacttctctaagcctcaagtttcttatccaaaaatgtggatataatagaggccagctgataggttgtgacatttaaatatatatgacaagcttatatagtccctgatacacacataaatgctagctgccatttctcatcaccaccaccgtctcttggggtctggacacgggagagggcttcacaggtcaggggctgtggggaaaatggacctaggctcaggctctgtctgtgactagagttgtgctgacatcaacagactggaccaggggccaggccaaagccctctgacccactaagtcctggcttctccttctccagaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtgggtatgtctgaccatccagacctgctgtctccctgcttcatcatccttccagcttcccctttgtggagcccatctgtccctgctcgggggtcaaagggtggtggtgaaggggctcacagcttaatgtccagaaccaggccccatacttcgtgttcaggctccagtctgagtactgttctcttcctggcacagcacgtggaggatggaggtccggccagtgaggcagggcttcgtcaaggtgacctcatcacccatgtcaatggggaacctgtgcatggcctggtgcacacggaggtggtagagctgatcctgaaggttagtgctgggcgtgctgcctgcatggtccctgaatgacctcagcctgtgagtctgtgatggcagttaggggagtgggtgagttgggtgcacacacatctacaccgagtatggatgtaggtacacacaggccgggcgcggtggctcatgcctgtaaatcccaacactttaggaggctgaggcaggtggatcacttgagaccagaagtttgagaccagcctagccaacatggtgaaaccctgcctctactaaaaatacaaaaaaaaaaaaaaaaaaatgcctgggtgtggtggctcacgcctgtaatcccagcactttgggaggccgaggcgggtggatcacctgtggtcaggagtttgagaccagcctgcccagcatggcaaaactctactaaaaataacaaaaattagccaagcgtggtggtaggcacttgtaatcccggctactcgggaggctgaggaaggagaattgcttgaacctggaaggcagtttgcagtgagctgaggtcataccactgcactccagcttgggagacacagcaagactctgtttccaaaaaaaaaaaaaaaaattagccgagtgtggtagcacatgcctgtaatcccagctacttgggaggctgaggcaggagaagtgcttgaacccaggaggcagaggttgcagtgagctgagatcgcaccactgcactccagcctgggtgacagagtgagactctgtcttaaaaaaaaaaaaaaaagatgtaggtacacacagaacttgaatgtggcacaacagagagttttctccacaaggcagtaccctccctgactaaggcccagggatccttctgagctgtgggtagggctgcagaatgggacggattagcctgttttctaccttcttaccccaaaccactctggggctccaatgggagccatttcctcatctgtaaaaacaataatataggcctgtggttcagatgtgttggtgcagggacaaaaagctggagctgtggtatagccatgccagaagggaaggattgggggaggggaggggcaagaatatggctccagcttagcctaggcctcatgctctgctccccagagtggaaacaaggtggccatttcaacaactcccctggagaacacatccattaaagtggggccagctcggaagggcagctacaaggccaagatggcccgaaggagcaagaggagccgcggcaaggatgggcaagaaaggtgagccaggcgcagtgaagagggttttctctgagccacatgagtgctggtacgtggtgggtgccttggccctgggggtccagtgtgtgctgtgctcactgcaccgactcagcctttgacccttatccccgcagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggtacgaagggctccctgcagatcagtgacaacccctgggaaataggaaagttcctaggccctgtgtgcttctgacagatcccactctgagtctctcatttagcccaccccctgaaagatcctgtagtcttggggaggaattaattgatggggaagggggtagcttggtttctgggacataacagggctaagccctgtcttgcccttgagtcacttctaacagctaacactgctctgcttttgtctgtctgtctgtctgtctctgtacaaagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatc

SEQ ID NO: 37532 - DNA, 122130 bp, Homo sapiens
ctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctgtgagtgccgccctttccgccctctctgcgccccggggctctgtcacttggggatggagcggcgggggttcgtactcagggagggggtgcggactgggttgtgtgtgtggagttgtgcgtgcttgtgcgtgttggaagactgtcaggttggagtggcggaagggagattctgcgtggaggtccgggggagtaggcgtgcgagagagcctggagaagaagagcgtgcctcgtggggtctggagacgagcgagcgtgggtcgtagagatttgggggttagccagcacgcgtcgtgcgggccatctgggggtgagtgagtgggagtctggagctgagtgtgtttgcgggtgggtgggtgggaaacgtctggagaagagtgtgaagaagtctgtgggggtatgtgggtgcgtttccttttcctctcctgtaatccaactatttggtgtctgagctccttggtcttccagtgggtaatgaatgaaggtgactgttgggtccagtctttcgtttacattatttattagttgatagtgtgtgtagccgtctcctgatccccgaagaccgtggtggcctgacttgcctctctgtgcggggcagaaggcagtcttcccccgaggacccctgagttagagggctttgacagttcctggcgacctgtgagtgctgggagtttgtccttttacgcctgtttggcattttacggaactgtgttccagacccttcctgtgtgttccctggggccccattgggcttgatgatccagtggggtggggcccaccctcaagactctctcctccataaatggtgcaaatgagttttggagaagtgctgcttcaggagagggtgccaggggcttggctgatttaagctgtttgtttcacccgaaagaggttcttttctgtgctgtcaggatgtgggcttattaggacttagtgggacacttcttacaggagatttgacaggaaaaaaaaggcattagacttctgtgtaaacatggtagaatagaatagtcttcttttacttctaacaaatctggtgcatgagtcaaatcccgttcagttatgggtaattagcatctctgtagaaccattagtacctttccagaaaaggcctagcttaaatagtccgcatttcggttgaataattggacatttttcctagaacataggaaaggcacagcagtaaccttaggcatgactatggctgttttaaaaagagaaaactggtgtcacaagttgtaaccagcacctgtggcttgatcgaagaaaatgtggcctgtgttctgactaccgtgaagggaagaaaagttaattccttttaaatgtaaagatcctgtacctctcaaaatggggcacgaatctttaacttggcccgagacactgctccatgaacaagtactacagagttctgaagacaaccaggaaccctttagttacagttaggttttcaatatctacttcttctgtggaatttactgagttagtgaaaatcagtggtcgtagggtggaggcagagcttttgtgaagtactgggagatagagcccagtattgtccttaggtagtctcttatttagtctggggtattgtgatttttcccttacatacggtagtttttttttttttttttaaatagaatcatgtgggcaaaatcagattaacttcttaagtgttcacctgttggaagagtgactcccaatgccatgtgtcagtggcattgtggggaaagcacttagttccacagaagtaacttcccagagagggcagggtgtcctcttatttgcactttcctatggtcacaagatccactttgccttgccctttaatttttggagcaaaacatactggttatttctttaggctttctgttgcctaggagtgacatttcacatggcataaataccttcaaaattgaagtccttctcttttactcacacatttgatgatcgagaaataccaaagtgggtattttgagcatcagtagactttagtatactgattatggtgttgactgattcgattttaagatatgagcagcatgatttctggttagtatgtagcaacacagtatgcagtgcaaaatggctatcctttgaaaaatatttgtgaagttttcttatttctgattaaggacaaatcaagcaaatgtgttctttttttctagacttcagacttctgaatttaaatcattagtctccgtgagtcttattctggaatttccataagagtatttatatggtttgtattcctggctaagattcagcaagactttaggggagaaagtgtctgtatatgatataatgaaatatcttgtagtttcaccaagtttacacgctctaagcccacggtgtctagaaaatgctttgagctagtttataaacccatgaactggatttactgcagctagttcaaacaacttcaggctgtgggtttgagatagcagaggacctgtggctttatgggaccttttttttttttttttttttttttgtaaacagtgcgtctgatgtggaagttgcttctaggcctgatataagaaaaataaaacttttaaatagtgaatgtaaatgcagtgtgaatagaagaaacagaatggataatgataatcggttcatttttggggcctgaggataacttttcagcacaataacttacagttgtagtagtcaagccataatttaagtctcccagcccattacgtaggtgagattggcatggtccaactagcacattcataaatagcaccaagccactgccaagccttattccaacttcccagaacctgagaagaagttgaacttcttagaactcagatatttgctttctttgaaattatttttgagagcatggcttcagaagctatttaagaagtattaaatacagtttaccttagactcttacctgtgccgtaaatttcagcagtgtttagtcacaaaatgttgctagtttaaatgtcctgagagctgaatggtagcccattgggattgggattaggattaggaaggcaggcctagaggaagaacaaaccctgatttttgttctcagtgtggagtgaagatgacagagcattctaaagcaaggatattcacaaaagtgtataccaagtgtggttatcctaagccacattaagatgagtttattgattttgatctctttgtactatgtgtttgcaataccagatcagttagcttaaatctaaccttgccagttttggcaaagaagtggtacttatgattaccttagaaaataaacaccaactgtggttgccattgtggttgggaagcaaagagggcctttgtctttcaaattttacagctgtgctggaaggcccaggtgtgcagggtgttgtgaattaagggtttggaaaatactttccatcctgtttatgcaaattaagtttaaagtgcagatcaccaaattgttctggaacctaaactgagattcatgttttttttttaaagtagattgttgtatggatggtcctgaaatatttccttctccatatcacttaaactcaacagactttgaaacaaaagtcttccgatttgtgggacagggaagaacctgggttgtttggaatagggagcattttaaacacaggttaattgccaagaatacagtctgaaaggtgcaagtgctcttagagtttcagggaactttagcttgagctcagagtccttttcttttgcaacaagtgtcttccctcttgttgggggataacttgtctgttgatagctctctgacaactttttttgagtaaggtgagatttctggcaaataatattggttgtcgtgagaaaaaggcacactgtttaagtcttgctgatatgaaattgtggccgtaatatctattctttgagtactgctaaagtaggaagtgtccagagattcccagcgccccatgtaaattaactgtgtattggcacacaatgtccctcttgcctttaggacatgtcagaactgttcctgccccgcttttcaagggactgttttaaaaagtagtgtattgtctctttgcataattatatttggttactagattttacagactttggacttttgaacatattatcagcagtaattctcggaaccatcttcagaaagatgaagaaaaattaagtgtagtgtgatgagagctggttcctagtggatgtcctcatgtcccatctccccagctctgcaccgttagctgaaagctttcctccctccagtgttaattactttgcctgggttctccctgcagcttccctgagtccattgggacggcctctggctgacctttctctccctcagacaccatgatcacaatgaaagggcctctcccgcttctgcaggggtgtctccttggtgcaaagtcttcagcctcctctctttcagggtggacaggaatgcaggagagagcactggggttttgtgtgacttaacaatgcacctggcccagtgctgtgcacctgctaaagccctgaaggtctgttagataggaaggctgggtggaggttgtttaaaatagcctatagttatttaaaaagtggcatgcacaggagagggaaatctagaagagggattcattgaattgaaagttgttatatgcagtaaaggatgttggttgtatcagagtctttctttcttcttttcctcgtttgtttaaaacataaaagggattcctctgacctaccccataggtagaaggactttaagtttcacgagcaagcctaactttcaattccttttgaatgagctatgtgacatttactcactgggtacgttccccctcctcagtgactgcaatttgaaaccctgggggtcttttaaaagcgaacagaactctgggccgtgttaatattcagagctgtttacaatggatgcagtttcaaaggctgatggcattgtcttgagacaggagggaggacgggtggaggaaaaattcccaggcagggaagggcaaatatctaaaaatctccagtgtttaccagcctgtgggaaatttagggaccgttactgttattttttatgacttaagcatgacactgagccactagggttcattctatctacctcatggcttcagttcttgtatgtcagttatgtggttatcttgtgcttttgtttcaagttaaagtgtggaaattggtaagaaactcagatcttatctcctctggaaagaaatagagcactttgaagaccagtggttaacatttttataatagtttacctctgggacctgcatttatgttttgctcaaagaatttgatatagctgcacagtttagaagagcagtcccgactgaccaattaattgtccaattatgactaggactgagaagttttttgctgaaatacttgatacatgaccattcttattaagcaaaatgaatggatcaataaagattgcagaaaaaatttgcagtttattgatggtctaatttctagttgaaagtcggcaatttgtgtctcttttttgtagggggtggtgggtatgcttgtgaacttttcttatacaaaggctttttgctttatatgttcttatattcttatattttgtataatttgttatcaatggtttttacctaagtactttatgcatagtcttttgaaacacaagttataacttcaatctgttcatagaagtccttcagttttttaagctgtttctccatttcactgggttttatacttttcatttcctgcctttagttctttatatcttctaaatgggcatttgctacccagctgtctcctggtctccatttgggttattgactgggggagagaatgggctagggacaaagctttcctcacctttactgtgttaaatatgcaggggctcttgccgctggtggtcacacccaactcacactcgtcattaaggagtggcggtgaaggggttgaaagttaattctgtggtccatccctggcacctccagtctacagctacatgtgtgattttgggcaaacctcttcatgtctaaaaagacagaaaaatgctctatcttatagaagctgtgaggacaaagttagatgatgcctatatttagctaggttcctcaacttgggtccatctactttatgatgattctggagcacaatttgaaggttaaaggcctcagtagctccaatttattatcctgtctcacagccagtctctccaagccagattccttccttcttcccttccccttccctcccccactcccttcccttccctctttctctttttctctttcttttctttttctttctttctttctctgttttctttttcttttttctttctctcctcccttctttctttttttccttctttccctccctccctcccttcgtctttcttcctttctttctctttctctctctctctcttttttttctttctttcctttctttctttcttttctttctttcgacagggtttcactctgttgcccacgctggagtgcagtggtgcaatcaagactcactgcagcctcagcctcgtgggctcaagcagtcctcccatctcagttgcctgagtagctgagactagaaggctcatgctaccacacccagcttccaagccagattgctggtgacagaggctttcctgggaaatgtttacctttctgctgtgaaggagtcttttggaatgggaagatggcagccttctcctgtgagttttggtgatatgtatgaagcggccttctcccatggatttttggtgatatgtatgaagtgccacaagtgaacctcatgtacccttggaaatcttagccaaacaggcaggaagctatgaacagttgcaacagattatataattagcaaaaattattgaggtattttataaatctattccagttgtacaaatagttatgtctgtttaccactatccttttggaagggaggcaggtatgggaaggtggcagggaagtgagaggcccttaaactaatcattttatcctattatttcccagggtttcattgaaactgagccctaccaaggtgcaagtagcacctctcagtcaatagcttggaaaaatgcaggtgtgctcttccaaacagggttaagttacagactttagggctaactgaatcctcactgtacccgcttctctttggaaaaccttgagggaggagggaggagggaggacaggagacaattgtggagttgtatgcaaagaacatttttcatttgttttggtctgtttggaattgcatagtaactttgtaggggacacaggcggggaacacagggtcatttgaggaatctggcaaggatgccacctgaaaagctgtttactgtttgctatcactccttgtgcacctgtacctgagttccttccccagtgaatggccatgattcacagccttgcccacgtgaacggccacgattgttttcgtctttattactatttaatctagcataaccggtaaggcccattgtgcgaacaaccaatctgttcatttctgcaagtcctaatacattttggtttccttatgaaccaggatgcaggttctaattactgcttgttcagtttgttttggcaaaaggtgacatttagagggtttaaagaaagcatggcctctttttaagtgttttgcgttgattagtttttgaacttttgtggtcaaaagttctaatctcttatcttttatgatctgcattctcaagatctcacattattgggaagaaaatgaaggaaatgagtgaaggtctctcttacaagcagaattagctggactttgagaaacacgatgaacgtaatgcagggtttttcttcttttttttagctgattagaaaaaaaacaactcacaactttattttctaagactcctttatgcagcatttaacagcttccccctccctgttttgctccttccaccaatttataatttgccattgaaatattttactgcttatcttggtcaaagcatacattgcactgaacttcttttcttccggattacctacttgatgatagcctgttaaatgcaatgagaaggattgaacacttctgaactggaggatagataatcttgctgttgtttcaaatcttgtagttccagtgctcttttgtttgaaagcatttgtctctcaagcattagcactttgggctggataacaagaaattaacaagctgggctctgcttagagaaaacttacaactgattagaaagtaagctgttgcaggtacagcttctttttcttgagagatgatctgaaatacatagcttttagaaaaaattttgaattaagggaacagttgatatgcaggcaggtagtttaaataaactaactcacttctgttgctctggagtgttttttcttaccttttgaatatggagaaaggtaaatatctacacaagtggacagaataatgtaatgaactctaggtatctgtcacccatcttcaacaatcatcagctgtcttatttgatctatttcccaatatgctgctgcccttccatgttatttatttattttttctttggaaataaatcaaaggcatatcattttatctgcaaatgtataggttttttttaagttaacagctttattgagatataatttatataccatactatttactgtagggtggttttaagaaattggaagttttgaaaaaattgacattcattttaactgtgtttttccaaagggcgttttggtaagctatatatttacagaatgtttattgggcacattctgtgtgcaccctagtttatatgttctcaaaatacagattttttttcttttgtaggaggtgtttagcaagctcttttgtgctagtcctctgccagaatgtgcaattctgattaaccttccactttctccacatagctcttacttgggaggtttctaccaagctattaattgttgattaaaatccattagtgaacaaacataattagaaatggaatagatcatttaaaaagtgatgtctcagatactgttgtttagtagagggataattagccgttggttgtagttaagtcatgagtctgaattgagttaactattgtttactttgtaaggcctgaccctccagctgtggctacttgaggctgctttaaatagagttagaggcagcctgtaagaaaaatcttcaaaaagcaaagaactaggttcctggaaccctctgtgcttgatttaaacttcacacagatttgaaaatgtgttctccaagtagctgctgcatggtttgttttattttataaaagtccatagtttaatttctcctcagtccggtactttgttggtgagggggcttctttagaatggattttttgctagctgcagcttcatttaggaatctgagtgggaattactagtcctccaaattccattcactttatcctagtttttggaatgacttccatcttctatctgtgaaaatcaaattccaggtagattatggagtgttcggtggccttaaaagctgtccaacatggtcaggttaaactggtggatctgtgaagcttaattaaatttatatgataaccgattatacaccatttacagtgggttctctgtttagaaaagtggaagcacgctccaatgcattttttttttttaaattatggggcagaaaagcttagtattgagagattctatgaaattaagtgctgttctgcaaattaggagaacaccattctttcatctggttttagcagtgtggtggtaccttgacccagcatcatgcctccgtcttagttttcgttttatttttaattaagaagaatttttctctgtgtctgtggtttcctccctccacctgggctggtgtgagtttctggcacacaagctcccagtgcttgcaaaacttataaacagtcagaagagctcgttgcttccaggaagtgaattgttgatgcaatgaagtgatggatgcagaggctgcagctcgaagggagcagggtttccttccatcttggaggaggggagatccagaaaacaagctgacatgccctgtagttattaagatctgcctcatcccaaattcctctgattgttttctcagatttggagtctgtgtaggactctttgctttgggtggtttggccttatccagggctatgctttacccaatggaaaaatcagagactcttctatggagatttttgggttctttcacaaggtcatttgaaacaatacttagaaatgagtaaattatattcatttcattactatcctaaaataaagattggctgaccttattatttacttgggagaaactttatgtgaagtcgtggtgctcagaatgtctttctggacagaaaggagaccacgttttcatggagtttcttaaaggggtgcttgcccaaagaggcataaaaatgattcacctgagaggaaaaaattaattttcttaaagtcatgaaagtgaggatgtggtagaatgggaaactagctcatggctgggcctcaggagacgttggggtttcgtcccagctctgccactgattggcagcataaccttgggctagtcacttcatttcctgtctgtaaagggatgtataatttctaagacccctcatttttaggttcatgattctattctaattgaagcaaaaagggagtaaacttatatttcattggatggtaagaattaaattgatctgtatctaggatacttaaacattctctctctctctgtgtgtgtgttagacacacacacacacacacacacacacatacacacaaagggtcccactctgtcacccaggttggagtgcagtggcgcaatcatggctcactatagccgtgacctcccaggctcaagtgatcctcctacctcagtctactgagtagctaggactacaggcatgtgccaccacacctggctagtttttattttttgtgaagatgggatcttgctgtgttgcccagactggtcttgatctcctgggctcaagtgatcctcctgccttggcctcccaaagtgctggggttacagatgtgagctaccatgctaggccaatgtttgctacttctgagtgaaattctcagatggataccataagcagcaaagagaaaaaagggtatgtgcatgcagagtctcaatgagggacccttttgtgagccttgagatattattgaggaggagtgaatactccacaaagaaagtggtgctttccttcatttttacctccttttcccctctggcccaaagaaaactgtggaggctggtacagatccactttcgatctttgatttagaattttaagaacttaggtaaaaatttaaagaaaaaaaaccaggaaaataaattacaggcatgttttcccaaagggtcctttctcagggccactgcaggcagcatctttctcaggcagtccttcagtgaatacttgccataagtgaagttgtaaatgatgctgagaaactgcctttaaggactggatgggccacctgtcacattctatagtcatggccacaggaagggcagctactcactgcactgcctgttctttctgggccagcttgccatcccttttaccagggagatctttcgtgtatccctttcaagatagaaactcagccaattaacatgtacagcctagtggcttcctttttcttttttgaggcagagtctcactctgtcgcccaggttggcgtgcagtggtgtgatctcagctgactgcaacctctgccttcctggctcaagtgattctcttgcctcagcctcccaaagagctgggattacaggcgcctgccaccaagccaggctaatttttttttttttgtttttttttagtagagacagggttttaccatgttggccaggctggttttgaactcatgactgacctcaagtgatccatccacctcagcgtcccaaagtgctaggattacagatgtgagccaccacgcccggctgtggctttttctaattttgaagtctgactctgtttttggccaaattcatattaaatttacccatctacctaggtttgcattggttacctcttagttacactgtttttgaaaatcttgaaaattatgacagtaattggactccttaaaatacttttcatggagaatctagaagcttttattttctttgttctggatgtccacttttcttcgacgtggaatttgttagtgccttcagtggaaattcttgggcttttcttttccttccactcattctttatcgtgtaaattttcataaaacgaaacttccggatttaaaatttatttttatttttattattgttttccggaacaaattcttggaatttggagttttgtttggggatacaactaaaatgcaatgaagttggaggaacagttagtggtctggaacttcttgacagaagtttaacaacaattagggactactttaggaatagagtgtccaaaaaactagactttacaaaaaaaattctccctttaagaaccaaagatgacctttttccattgtgctttctgagctcaaaacaggccaaatgatgttcccacccttcttcgagcctcgtgtgtcagtgtcacacactctccctgttactcacttggtctcgttctggtgaatttattgttgacatctcgtcctttcccggaggaatctctgagtctatctgattaggtaactcttcacacatccctgtatgtgtgtatgtgtgtgtgtgtgtttctctccacttagacttgaaagcagcagggatcattcaatttcatgtacctaggagtcccttgataattatttgtttattgccttaccactttgtcttggagcttggtacattctttcagggcagaacggatcccccagtttcattgtttctctaaggggttctgaggtttacccctgaagtgtaatttttcctgattggcctgtgtggaggacttcataggagtgtttttagaatttaaatatcaggagtaaaaggccattttctttgtgctgagggtctgttttcccctctggagccagcggctaaatgcagaggctttcttcaattgctgttgcttcttgcagtgtggcccctcaatgagaagtcatagcttgtggtttgtctgattttatatgtcagaacttttagagagaatatttgacctaaaacaaaaattatggatagtcctctcttcctttcccatttctccttattttctactttctgcttgagaaccacttcaaagaatcagatgtgttggtgccagacgccgtggagttattgttagaagaatttggaaatataattgaaagcaaactttgttgagcaaagcagatctaggcaagtttttactttgagggcgaagggaattccaagtttttcctctatttggagctgatgtctcagaacacttgttctgtgagatgaatcatctgtgaattctacatctgggagttatatattgggaaatggcattctttttaaatgtagaagaaacacaaaagcgtaaagttacagtgtagttggaaaattctagtcagagtttaaaatactagcattgaggtgaaattggcagagtgattggacgtgagtctgtgatacctaaaatagacatgtccatacatggaaaacaatacgatagccacacttacttattgtgacccttttcgtttgttttgagacatttttaaaaagtcataaacatcagctattcagaatcattagttgagtcgattgtgacttgagaatcagaatttaagcgtttgtcttgagctctttaagttcaggtgccttgctaaccagtgaaaagcccagagcagtgcagtatttcagggtcttcaggggaagataatgttgtgtccttgtcttctcagagtcctgcattccaggcatctggttatgaggggccatggttgtggggatgcagcagctgtgcggttcatgacgcacggtggttaagaggcagctctggggcctggctgcctgggtgaccttggcaatttactccacttcagtttccttttctgtaaaatggggataattgtagtgccgacttccttaagcttgttataaggaaaaaaatgaaatatttaacacagggcctaacacacaagcagaagcttgaggaagggtagctataatgttattattataactgtcgcaataatagtgtacctttctgcagcaggatatatctgtgttaactgatcatcaccatcttaactctatgaaaaatattgtctctgttgtatacatgaggcccagagtagttgaatgacttgtttagagtctagcacttgccagttagaattcagacctgcgtgtacatgtttagaagaaaatacggtaagactagcactgccttctttctggcctccctttgacgtctctgaattcctggaggccgattggtctttggtggcttgaagcacctagtgtagttctggctgtacagctggtgctctatacatggtgtcttgaatgtgatcttgaagagcgtgtttctttgttggtaggcgtgtgtgtcagatccatttttggtttgcctgtttggtaaagggggtggtaacatgcacatatgttttgccatctgttgtttattgtttctgttaggttgtggtttgtgttcctgttccatgttcctttggtttctggagcaactgcgaatattatatgcttggggatcaaaaaaagtaaactatttataaacagtaaagtatccttgggtttggaaagtgtttttctcaaatgcgtgtatatttgttggctttatgatcatctcactgatgaatcgttagataatttgcagactgagacacatctaaaagatgggcgagtcatggtccagccttgtgtaaccagctcacagacagccttggtgataaggccctggtgttaacgctgacccgagtggtgtatttttaactcaagaacatataaacagtttagcctgctgatggagtttatgcaccgcctgaaatctttggcatgccttggatttgtggctctgtaagatgtacgtagtcctgggagagtgctgtggccgccagtgacccactgcccccacccttcattcaaaagaaaaggaatgtagcagcaagatggaaggagaaaggtggaatttatcaataattttgtatgataatttttccttttttttttttttttgagagggtcttaatctgtcacccaggttggagtacagtggtgtgatcttgactcactgcaacctttgcctcacaggttcaagcaattttcccacctcagcctcctgagcagctgaggctacaggtgtgcaccaccatgcctggctaatttttgtattttttgggggtagagacagggtttcatcatgttgcctaggctggtctcgaacacctgggctcaagcaatcgctggcctcggcctcccaaaatgctgggattacaggtgtgagccaccatgcctagcctgtagtataaattttatcttaaattttttttgtcattactatttcactttgttatgcagactttagagggaggagagagctttttactcacatctgtttgcaaccccttgcccccagctgtaggggtctttgcagagttgcaaattggagcacatgaatcccattgtttaaagctgttactgtccacctgcccctcatcgcgcttcttacctggccccacctgtcccagccaccacgtggggctttttaaaaagactttttaaataccaccatgtcccatgtccctcacccaccatttcctctgtctggagaatgggtcttccctcttcgccttgcagatttctgttcatctgtcttaaacgtttctccccatagaaaccatggctgacgttccctttaagttagattcccatcgtgaggattctgcagtgctatgtatagaagttttgtgtgaatgtttgattcgtttctgactaccccattagtctgtaagctccctgaatgcagtgactggctttgtttccaatccaccattgtattcccagaatctagtgtgaagcctgtgacacattaaatgctcgtgacagataccagtgtagatagagatagtggcattcattctgtagagtcctgtatgtcctgtggaaatacctctgccagatagaataattcagacctcccaggcttcatctgtgtatttcctgaatataccttgcttgtttagtagcttcctatacccctcaccaccctccaccaaagtctcttaagtgttgagaaacttagaagaatggaaagaaagaagaaacaaatagaaccgaagttgaaaagatgacaggctgtttacctgccacatttagaattggcggtctttttggtctctctgaattttggaaaagtcccatatgcaagaattgtcactgaagtggctttgtagttaaagcagtgcatgtgaactgtccccacatgaggtcctcgggcgcctcgtccctgctggattgctggtggctgtccttggcaggtgggccaggctcaggcgctctcctctgtgttgcgtttggcgagggagcccgcggtgcccttcccagctgttgacatggtctctcatctgctcttttgctggagccgcgttttggagcctgcttttccagagttgacactgcaggggagggtggcttcttccatagaccgaggctgtctagacacccttccccttgtggttattctgctcagtttatgctgagccctcgccaggcagctggtttcggttgcttgagctcttactttgctcaggcctctgctttgacaaaaaggatgaccaggccaaggtagcttttctccctctttgctgctggcagagagaaagactgctttccttgaccagagggagctgtgagaacactaaggacaggttaccctgccctctgtggacccagcccaagtaactatgtaaattgatagaagcttctatggcaggagacttcaggcagatacatttctaaatctgggcctttttagcttggacttcagatgtgagacattggcccccacccccatcctcagacacgcaggatctccatccatggcagagagagcactgcgaacccagctggcagagctcctctctgggcagtctcccaggcatgctagcaaggggcaatgggaagctgtgttctccctgatgagctcagcctcacatgtttcttttaatggctatcgagatcttggactgtgatgctgtagggaagccttttgtccccagtgagctggaatagtctaggcagattactgtcttggtggccttacggggggtgctggagggggtgctattgatctgttagcctagttactatgtctttattacttttgattttctggtgacaaatgttaggcatttattgaataaagaagaaagtacaaaagaaaaaacaactgatttcattgttcggtgataaatattatcactggatagtgtataaatttccagtaatgtgtgaggctgaatacctatttcagttatgttttaaagactcaatatcttgaatattttccctgactttaagcagtttttaaaatgtgctttaatatttattgtataataaattattacacaacttacataaaacttgtaaagtttctctgatattgggcatttaggctttttcctaagctttgatagacatccttatgcataaatgtttagccatttatttccttaggatgagttacccaattcagatagcgctggatatgcagattcttaatattttcggtaccactgcctctgagaaagaggctgccaacttacatgtgaacttgtgcttgtcccacaccctcacaaacattaaatgctgtttatttctgtaatcatgtaccagtttaatggatggaaattgcctcagattattttaatctgcatttctttggatgttgaggctgaagactttacacaggatactcccagatatttcctttttcagtttccttcctttgttgatgctcagcccagtacatcatctgctgtcctccactgtggtctttgggcttgagcacagtacatctctttggtactagggaagctgtgtttctgagagagcacaggtgtaattgcatagaaaactgtgctctcaacaggcatgtcacatgttttgactctgaaccaggacatctttgggttcttcttaaacagatgtggacgcgtgttgcggaggggactgttgcagtggctctgttgatcctgtactgctgcagccttctgcagagccagcctgcctgtgcccaggctgcccggtctgtggccagggtgcctggtacctacagctggtaggaatcagcgcagattagcgtggctgagaacctttcaggaacagcttccagcaaatggaaattattttaaaacaaatttatgtggtttttctgtcaaacctacttggagcataaacaaggttgaattgtaagctgcttcccttctgcaagcgagcccatgtttagaatgtggctttcagcaaagtaaacatggtctcgaaagtgagttgtcattgtatgcatgtgctttgaaaagtaaaagtagtgcactgaacgagcattctcatagataattgtgatagagttttagacatcccttctcgtttatttgtcttcctgccacaaagatcactacttcctgtaaaggttttaaaggtaaggagtaatttggtattgaaaggattaagggaaagaaatgccaggtcagtttctgtggtgagaagcattttaattttgctcctttgccatggggaatataaaaaacatcttttgaaatacttaattctgtgtgcatgcgtgtgtgtatacacgtgtgtgtgtgtgtgtgtgtacataaaccctccggtctgtgcatctttgaattctctgccaatttcgaggtggttccccccaccctagggacaatgtcggctttattaaattgggcacagcctccctagaaggtgaaacaatgcttttaatgttctgattatatattaatgaacaaccaggccaaggggcacttgccaaaaaagctacaaagtgagaaagccaccaatatcagagtgaactttgcactctgaaagtgtgaatgatgttgggtgaaagagtttatggcgcaaggggagcaactggaatctctttgatgttgtgtagcatcctggccccattagactttgggccttcccgtttaactgcatctttgctggcgagggcagtgctgaggtgtggtctgaaatatagagggacctcagccacagaggactggcatacctgtgctgggcagggggaccgttggccatttctatctgttttcaatcaacttcaacaaattttaatctaacactgaaacatatagtttcacacccccaccctcccagcttttactctggagggactttccagaaatagcatgctattattctcaaatccgcctgccccaaccacagaaaagggttagatcttaatcttaatctaactgatttattttctccccattgtggtgacatttcctcctgccttctggcttggtcttaatttttgaatggccactgggagccctgctttccacagccttgctaaataatttctcaaaggaagaaaagaaatgctctttcaaaatgccaagaatgtgttttctgtgggagggtaaactctagctgaggttttctgcatctgatggactcatggacagagcttgggagcgagtataggacaatctgggaagcacacagaagctgatgttctttctgggtgttcttttgggtgttcatttatctcctggcacgtagaggggcagttctttctgcatttctgtggtatggaagtagctaggtggcattttcagtctggaattctgagagcctgctaaggtgggcaacaggactttttttttttttaaatagcttttttgagatgtgattcaaataccacaaaactcatccttttcaatgataggattctgggtttttagtatattcgtagatttgcgtaactactaatctagaacattttcatcaccccaaaataaaaccctgtacccattagcactccctgcctatccttccttcctcccatcccccggcaacatctactttctgtctctatagatttgtctgttctggacaattcatataaatagaatcatgcaatatatggccctttcttttacttagttacttagcacagtgttgtcatgattcgtccatattatggcaggtatcagtacttcattaatttttatggctgaagaatgcttccatcatgaggagagactgtattttctttatccactcatcagttggtggacactttgtttatttccactttttggctgtaatgaacaatgctgctgtgaacatttgtgcgtaagtttttgtggtgaatgtatattttcacttgagtatatacctcgggcatataccgaggagtggaattactgggtcatatggcaattctatgtttgactttttgaggaactgctagactgtttcctggagaagctgtgtgcaccacgtggcacatccaccagcagggtatgaaggttcccatttctgcactacctcaccagcacttgctattatctgtctttttaaattttagccatcctagtgggtgtgttgtggtatcttgtgttgtggttttgatttgcatttccataatgactaatgacactgagcatcttttcatatgcttattgaccatgtgtatatcttctttggagaaatgtctattcagtttctttgcccgtattttaactgagtcctttgtctttttattgctcagtggtaagcagagcatgtttagaaagtacaatttcaagcagcttggggtattcccctggttggtagtgtgcttttctctatcttcctcaggcgagaagagtttttatttttaagactttgaagatctacaggtagaagtgtaatgcctcataacttgcccgtctgtttggaatctcaagggaaaaagaaaatgtggcaggaaagagcagtggttttccttgcagtgaatccagactacagacgctctaggggagcttattacatagtgtccctaggagaatgggagaatttgctctcctgtaacctaaggaaattggctgtgcatatgcatttatggaagagcctgaccgttttctctgcatttcctctgttccgaggcaggtctgcctttgccgacggagctttgcagctataaattagacagaagtgcagtattgaggctgtccaagtgcaggcagggtaattgctctggacaggtttacaatagggaggtgtgaagtgcttggtggagaccagaagctgggggaagggaggacgtattgaacttgggcggctgcagggtgatgggctgacagagctaattgaaaactatggccccggtggcttttaatgggaaagggagccgaggcctgcagtggtttcctttagagcaagaaaccagaaggaaaatggctcattgagctactcagggagttagtactaaatctctgcaggcctctgggggtagagggtcaggttttctgagttttgtttttaatttcttactccttagtcccattctagatgaactgacaggagggtggtggtgagcttgagaaaaggcctgcggggacatactggaaaaaaaagctgacccgtacagtggagacccttggagatccatgagttagggagatggtcagcgggctgaactgcctatagacaagtgagataataatgacatggtagcctctgttagtcctctagtcagagtttatggtgccagggcctgggaatctgcattgtaaacagctgttggaggaaattgctttggagtcttaaatgtgagggcagactccctgaaggcacagcctaccttattgacctgtgtggtcctcctggcacgcagcaggtgcttaataaacacctgtgtgcttatttccaaaccaactgtgagttaccgttgggttttctttcttgatagtatccaggacactgctttctcatgtccctgaaactcctgcctgcgcacacctgtcgagataaccatgggttggctgtcctacacatctgcccttaagttaactgttattttctgccccattggggttaactggttaccttttcaggaccacctacatgcactgaaattagttgtgtattaaaagcaaaaacgtagaaccaaaaactggatttatctccatttatttccaattccatggtagcaacgtgcagaaagtccttttcaaaggcggcaaataaacggtgtggagatggtggaggtgataggattttccttgagatgtgctgtggttaatgtgtaacctctttcataagacttatgtagatgttgatgcggccttgaagccattgcaggcccacaaactcaggctgtgtgtcgtgtgtttgtagcaagtccatggctttgcagctaactcatacccccaaggtttaattttttttggtcgaaacaacaaccaacatctgtttggtaatcctcctatcctacagcaggccactcctatcctgtagtgcatcactcaaatagttgctggagaaggctttattagatcacctcccctcctctcccctcttcctcccccataggtgtgtctccagcacacctatgcgtgattttacatttctggctctgatgataacatctttaaaaatgagagaatgaacttaagtgagataaaggaagaaaggtggaaaggataaggtttgaggcgagaggggattgggccctcctttttgaggatgactgaagtataaaaacttatcttctccttgtaataagacatcttggtctgaagtccagacagtttgcctcttggatgaggttattccagccctacctactgctccattgtgccttggcatctttggggattgtccatttggaggggccagattagaaaaggaagagcatgattacagcaatgttttaccagcaaactaggatcatcttgtcctgtatttttgccttgccagaattacctgttttgtctgagaagcaacattaagcacaggagtttggataccgtggaatccagagggcaaatgacccgggtcgtggtgtgtctggctcaagaaataacattttgaagtgccacctggccctaatggcaacagcagccatcagttaaaaaaaccagctgttaagtaagagcaagaacaggagtgtttgtgcaaacaacctttaaattttctgatccttgatgaatgttagttggtttgtgaattattaacttcagcgtgtgtgaggaaatactggctgcttaagtatatttttatgtaagaaaaaaataaaactgaccacaccctcagctgctaccattttgggctcagttcttgcctgctctcactcaacagacgtatttaaagcagagataggaatgcctgctcctcacagaccacatgtgtgtcgtgcgtcacagtgcatcagttgccatcacaatttcactttgaagggaacggaagtgttttgcagcctgctgggatgtataagtaggatgatccctaccgggctgcacagaggatccagagtcctcatgaggattttggtatagataccagtgtagttgggaagaatcctgcgtatggaatcagaaaactaggtttagtgaattatagaaagctggcttgagaaatccatttaatgtcactcagccagcaacttttaaagagtgttttgaggcaggttctttaatgtgaccctggagagacagccatctttttctagtgctttgatttacacagcagtgtgtctcgcaggaagaggccagcagatttgactgaggaactgcagtgtggcatcttggaaaaaggggatttgaggactttgagagataggaagagacttggagaaatccatttgtgaacctggtttccacagctgtttttcagaggtctcttggacctcttaaagttgatactaatggactacttatttcttttgacttttacctgggaaagagaattgtgattaggcccttatctgggggagaggagaggctaagggaggaaggggtgaaggattaaggagttggagagaattggaactggccagacagggctatttgagcttcacatacctttgggtattggttgctgaattaatcctgcagtgtaagtcacacttagacatgcctaggtgtgactcttggggttcatttactttactacagggtttaatctctgcgcatttcgagtgaggaaaacatgcttgccatgggaaggaagaaagcaggtgctctgtctcccttccccacctcttcattgtcctcagttgcaatgccatttgatataggtagttctgaaatacattgtacgctttattcccaggctgcagggattattgctgacatagaccatgggtcctgcagccagccccctgtgtatggaaatggaagaaaagaaatcaagctgtaaagaatctctgttttggggctttgtagtggcgaattacgtgaataactgaattgaaaaggtgcctggtttataccatcgtgaatacccaggccttagataaatattgacactagtagtgtgacgggcaggcctaccatttgtctcatgcccctaggaataaacgatcttttctcaggtgcttgtgaccttataaaccatcctgacgagtttgtgcaggtgctttctgcactagttctttgagagtggatggttttctccctgtgcttatgtgagcttaaacctaaccaaatctaaagccactttggcttattgatcctggttcactttgccacaagtaaacgcagttgtcagcacagtttcgcagagtcatgtttgtgtagccatgcggactagacctgggattggaacagcttttatttactttgataatatttcaggactgagtgtggtggggagtaaggagaaaggaaagccagtttggggagacttagctggagtacaggttgcatctgatagctgagtgcctgccttttccagcaaactgctctcacccccaaccaccaccttttgtttggttccctatatctcagggcatagaacaaaacccacttaattttgttagtgtgcagtatgcagacgcaagtcattctccacccttctacctccctaccaatgatagcatgtttattggagggaagtcatgttggagtcacttgatttaggacaggctaggcagagactttgacaaacctcgatttgtcaaaggagtgattggtagaacctgggagattgtgtgttcgttatatagcaagtgttaggctaagtcctagctgttttcatagggcagctgcctcaatgtagctgatcttgtggatgtctcaatttggtatgaccagtgggcttggattttctgtttggatgtgaagatgctctgtgaattgaatggctcttgtctctctctagtgcacagagaggctgtggagtacctagaagtacacatggtgtttcttagatttctgcctgtaactgaaactccaaaaagagtttactgataattgacttttgacaaggctcttaaccacctttgctggtgattggctttaaaagaaagaactcatattccacaggtaccagtattcattatttggttaagatacagtttagcaagtggaatttgccgctagggtccaccctgtaagacacatcctttgtgagtaaatgacctggacctgcaaatgggagtgggatggttggggaggggacaggcgtgtggtggggtgatgcacccagccacattgaatgtagatggggccgggtgctgtggctgacacctgtaatcccagcactttgggaggccgaggcgggcggatcacctgaggtcaggagttcaagaccagcctggccaatgtggtgaaaccccgtttctactaaaaatacaagaattagctgggtgcagtggcgggcgcctgtaatcccagctattcaggaggctgagataggagcatcacttgaaccagggaggcagggtttgcagtgagctgagatcacaccattgcactccagcctgtgtggcaagagtgaaactccatttcaaaaaaaaaaaaaaagaacgtagatggaccttgtggaagaggtgaggcattgtttttagggactttggcgaatgatttaaaaaaaagaaataaaagtgtgttgtggcctagtcattttcacagccagttttccatttgacatagtaaaattttagtatgttcaaggatggaggtcgcatgcagcatctgctattttctgcttgtaatttcagtgaaaaggaagttccatgttttaatagcagcatagtctgtgtacaataatgcatgctgaaatactttgtggtttttgaatcttgacttcgtgtcttctcagccatttcaacaaccagaaccagggaaatcatcactgctccacgcctctaaacagggaaaatgatgtggtagatggtcttttaaatttagagtgtttcacgacgtcttagtactgcagaaagaaaaacttagccttttggctttagctaagcatttcatgacacacgtaaactttaagaagcccagtggaaaaagtgaacaggacgagatcccaagtcgataagctagctattaaagtcagtgacttcactgtgggccagacggctgaccttttaaaactgtgtgttttctttaaaatacttagctagagatagtcgcgtgcctccctgtaatacagcggatgtattcttgaaaagttgtgggtaaattcgcttttctaatttggctgatttaataccagggatctgctgtctgtatttgtatgatctgcattgttttgaggcagctgagaaagagaggataaacctagaaaataatattggaaggaaccttgtacttaatccatttgtaacgccgagcattgtggcaaatgcaagtaagcatggatttttatatgagctttatagattttggatgcttgggctttgcacaggcaccaggagacctcacagagatgttagtgagctgtgggtgtgatgtcacacagttgaaaaataaaggacgtgtgtaagttccagtggaggctgatagaggactcccgtactctggggaacttctggcttcccaggaagggtttttcttacaagcagctccagcctggaaaggtagttacacccacttatgtcatttgtcccttaaaattttttgtggatggggaatgaaggagatgccagtagcactaaggtaagctgttgtttgtgcagatgtatttgttgaaaacaaaccactttcattttcttcttcaaataggacatataggaaacctatacattgctcttttgtaacccagaagggtatttgcctaaaattgcccttctcagtctctttaaaaaacaacaaaaacccctaatcactacacgtccagaagtgagtcaccactgagtttgctttttttttaatcttctgacatacatttctgtaacatgaggtttttgtactaatattttcattgattggattatgttagagagtgaattgtcaaaatgagagttaaaaaggcccaaaatgtccgatcctttcctggtcctaggaaagtcctagacaagagtgtttagaatagtgtgtaatgaatgactcagatggagggaaggggttttttgttttgatgttttaatctgtgtctgtcgcacccagaggaagtaatatattattggaggtttcattcttaaagaaccaagagtcactgctatagaattttcttatcactttatcccagtgaaatccgtggttgtaccttctgccggaaaggcaggcttggaatttggccaccctgctctcatgaccaggagcaattttatgggcctgtgttaaaacaggtattttgctctttgatagcagggttcatctcagggcccttaggtgtgagcgtgtagtgtgtaaaatcactcaccgttaagtggtgaatcatttcagtgtatcggaacaggagattcatcacagcatcacttacgggtggtgactgtgccaaagtttacgcaattctgttgtgtggcacatggcagtcgaagaagctttccttgttagtttgcatctttcctgtgaccatccgaagttagtgttttttttttttttttttttttttttttttgagacagagtcttgctctgtcacccaggctggagtgcagtagtgtgatctcggctcactgcacgctccgcctcccgggttctcgccattctcctgcctcagcctccccagcagctgggactacaggcgcccaccaccacgccaggctaattttttgtatttttagtagagatgggatttcatcgtgttagccaggatggtcttgatctcctgacctcatggtctgcctgccttggcctcccaaagtgctgggattacaggcatgagccaccacgcctggcccgaagttagtgaattttaaagctgcatcacattttcagaaacaccctggattttgcattggtggtttcataggaagctaatcagtctcctgaaagtggacatttagcaggggccaggggcggatgtggaggggtaaaggtggaagttttaggaaaggaaaacagtaatccgtgaccagagaagctttggtggactttacaaagcacttggtgaacctgggattccaaatgtatccaccaggttaatgtgtcctttttctcagttttacccatcccatatttcctgtcccttttgcctgacttgttttcagtactccagaagcaaaagtctccgttttctgccgcagtagagcgtggttttcatttatgagaaccctctgccatcctttaactgagagaacctctgggttttacctctggccgcccttcatccccgccatgccctccgtccctgctggttgggatggatgagcctttgctctccctgcagcggctggggccctaggctgtcagggcacctcggggaagagttcagtgggagcagggagcacctggctccaaggttccaacccccctctgttctgcagaatgactgggctcccaggaggtaaagattcagctctgttactggatggggtgaggataggggggctattgtgcaggtgatgagtttgccaagtcctgtagagcttaaggactatgtgaaagttagtgaattagtgtttctttttggagatgataaagtagagaataggcgatcctgaatgaccagacttctgacccatctcttcccgctccccatttccaagcctctgcaaagcacttctctaatagcaaagccaaatggtggctgtaggcacctcttgcctgctggggtggccatggtgatattccctttgtggcaggtctgtgggagggtcagcctctggcagcagctattccctgcccaaattccttttgcttgtaaagtccccaccaactgcagagctggtgtgttggagcgcctcttcttaattaaattaattaatctttaggggttaatgatgcacataccatattaacaagagactattatgggaaatttgtgggctttcctcagtactaaactgcactaaagatgagactgcttaaagtaaaacaaaacaaaacccattatagctaattattttgtttctttttggccaaactaagatttttggtaggaaagatcctagaatctcccattttaaggggtagtatagaaagcaaatgctaactgccttcagtgatggtgagaaaacaaattgggcctcttgattatctagttcagaacttttaagtaaatgaacaaggcgatactctgttcttatggaaatcaactttaatggccccatagattaatgttcgtgagggacctggcactggggtttgctaaggtttatataacccttgacttaaccgcctggtgggttgtgggtctggcagcatggggctattcttctcaactttgctgtaaaaccatttgtgtcttgccctttcctttctaggaggtcctgacttcttggcctttttgtttgcttattttactccatgccctccattccttattttacttttctggcctcgtttcccaggactcctcttcaaaaaaacatgctcttcttctaggcttagctgaaatcttgcattttcaataaacgtttctcattacagctgatctttcctgctctggacgccatctggccttcattcatgttatccatgctagggatgacaaactcagatctcgggctgggaagatactgccggtgaataaagagggcatgggtgagacaataaggagtggtgaggtctgtggtcattggaatgcttggtaaatgcatgtagttgattgtttctgttaggaatgctggccctccgattattttcaagaaaagctgaaactttagtttttggtgaaaactttaggtttctaccaacactgttcagtcagaaacaagcaagtttccctgcagcccagctttgtacccacaaactaccaatttgtagctactgatctaccattacagaatgcttgcaagtgtcagagcctttggctgtgttatttggtcagtattctttttttttttttttttttggtagggacagggtctcactatgttgcccaggctggtctcaaattccaggcctaaagtgattccccgactttagcctccgaaagtgctgagatttataggcgtgaaccaccacacccggccaggagtcttaacttgaccagtgggttgtaaaccacttcaagtcacagactagatcttatcctaatttgttatcagtttatcacagtgcagtataccttgtagacaataaatatttgtcaaatttgacatttgttgggtgctagagggaaaagatgtagacttgtactcaaattagctacagaccaggatgacatgtgtgaactagtaaggccgagaagcacatgtaagaccttatgggatcacagaggtaggcatgagtttcttctctcagttaacgtcacgggcgttagacttcagaggcccacactgattattatagctgatttttaaggagtaaaaataggcaatgagtctgggtccatatatagctgtatgtatatagtatctcctattttgagtcactgtaggtttcccttatttgcatagataatggtctatgtaaaattttcagaaatggaaataactggtgactcattactgactttgtgagatacaactgcccaaaagcttacaaaatgagctatttgtatcatgttgagatctgagtgatttttttcatttgattatttgcagaatatgttcttttgccatagggaatatgtggctgcttagcttactgaagagaggtagcagcaagtacagaaccttctcctgagtggagatccttggataggatactagaggaatgattccagttcaagatacaattttgtcatcttaatataagcctttaatgtgcattatccgcttgttcagttgtggtttttggttaacaaggggaagcatcacaatacaaaaaaaggtaagaacatctaatattctgggatttgaacgaagtcttattctcttttataaaaccttacaacatgggaacataatgtggtgatttcattggagcttgatgtgtactatgtaattcctcagaaagtaaaaatgcagcagaaacagtcttaaaagcttaaaggattaaataacttaaacattgttgcatgttcttccttatttgcacccgctgaaattttgaaaggacgaatcacctttttccacctttttctggtgagtcccaagcaggcaattttttaacgagtggctgacagtgcacgttctgaggttgagaaagagatgaatcgccagagcccacggctcccaggccagagctgggtgcccactggtgctcagaagttgggttgttggattgcctcacacttactttccagctgtattaatgcagtttagcaaacatctgaaagcttaaaatatgcaaaatactgtggcgctcaggagtccagacagaattgagtaatgggaaataggctagcctggaaaccaaaccaagtatgaaaacctcattcttcagggaatgcttgtcacggatttaggaccaattccttccactttgaattattctgttaatgttgaaaaatggagccatgggttgcgctcctcttcacagtgagagattttgtctgtgttcgtcagtggtctgtgagcaatgcttgcttttggggatgaagtgataattctgttgtctaacgaagtggggttgtttcctcaccacagcttactcaaaagtaaacaactttttatccctcaacttccaaggagtcaatgaattactgttcaccagctttgaataacatttgccaagtttgtaatatgtggttctggttgtaatccaggaaggtgcttgtcagattagataaataccgtttaagcctatagaattatactctgagggcagtttttattaagaatgtcttcctcataacttcagtttttgaaggctctttcccttgttgagatggttcagaactttttgtgtgctcaaaggacttgtgttaatatcagtgtccatccctcaccacagccttttacatagttctcgagttattgggtagctcagatttgtgttttagattcaagttgcttctgtaggtgacatttaacttgaaatgtttgtggattatttcatgatatagatatattcgttggttattttgtaattcagacacagcacagtttaatagaaatttcagtgctgatagaaataacctctgtctgcattgtacattttgatagccactagccacgtggtactgttgaacacttgaaatatagctaatgtgggctgggcgtggtggctcacgcctgtaatcccagcactttgggaggccgaggcgggcacatcacgaggtcaggagatcaagaccatcctggctaacacggtgaaaccctgtctctacttaaaaaatacaaaaaattagctgggcgtggtggcaggtgactgtagtcccagctactggggaggctgaggcaggagaatggtgtgaacccaggagacggagcttgtagtgagcggagatgcaccgctgcacgccagcctgggcgacagagcgagactccatctcaaaaaaaaaaaaaaaaaaaaatagctagtgtggccaaggaactgaattcttaattttatgtaattttaatttcatttaaatatacatgtaaatagccagtggctactaaattggacagcacagatttagatagtggtggggattttgcagctattgaaggactttagctcttcggattccttggggttggggcaaggggacttgttaggaaacgtgctcagcgagcaaactgttgttgtgcactggtaaacagtttgcttttcagacacgcctggataaaacttgagctgtcctctgcagaggtgcctcttgtgtgttcagcgaacggtgggctgaacggtcatctttcagcagattagctgaaagaacatctattgctgggctcagttgttcagagatctgcgcaccctttgtgcaagagcagggaaaatttgtgttatgacaatggctgacagaatgtttaattaaagctgcaattggcagtaactaaattctccgaggtttctttcctctcctctttgctactgaaaggtgcagaaatgcttttgacagcatctttcctactgacagatgaattgttttgacaggagaatttgaaaccttcaactgaagacacattcagatgtcaggcctggtacagggcgatcgtgttcatagaaataagtgagatgctttagatgtgtgtgcatgtcagctgccacctgaaagaaaggcctcattaaagattttcactgattaactctttgattgttcttgggatctcagatgggaattcacgctgcttgctgcagagctcttgggctaagtgtattttcttaattactgagaaatgcgtgttatcagtaagcagtgaaaagtcttgaaaaaactaagtaattttaaaaatttggaaaaaaaatggcaatgttgatagcaacatcattcacaatagccaaaaggaggaacaacccaaatgtcatctgtgatgaatggatacacaaaatgtggtatatacatacatgggaatattagttagccttaaaaagaaatgaaattctgccaggtgcagtggcttactccggtaatcctatcactttgggaggctgaggtgggaggattgcttcaggccaggagttcaagactagcctgggcaatatagggagaccctccccccaccatgtctactaaaaaagtaaaatttagccaggtgtggtggtgtgtgtgcctgtactcccagctacttgggaggctgaaacaggaggatcacttgagcccaagagtttgaggctgcagtgagccatgactgcaccactgcattccagcctgggtgacagagtgagaccctgtctctaaaaaaaatgaaattctgacacatgtgacaacatggatgaatcttgaagacattatgttaagtgaattaagccactcacaaaaggacaaatattctataatctaccaacatgaggtacttaagagtagtcagattcttagagacagaagtagaatggtggttgccaggggctaggacagaggggaatgaggagctagtgttcagtgagtacagactttcagtttgggatgttgagaaacttctaaagttctggagatggacggtggtgatggttgcacaacagtgtgaaggtactcggtgccactgaagagtacacttaaaaatggttacaaaggcaaattttatgttatatgtattttaccacattaaaaaaattatgctcaggccgggcacggtggctcacacctgtaatcctagcactttgggaggctgaggcaggtggatcacctgaggtcaggagtttgaaaccagcctggccaacatggtgaaaccctgtctctactaaaaatacaaaaaaattagccgggcatggtggcaggcacctgtaatcccagctactctggaggctgaggtaggagaattgcttgaaaacaagaggtggaggtcacagtgggccaagatcatgccactacactccagcctgggcgacagagcaagactcgtctcaaaaaaaaaaaaaaaaaaaaaaaaattatgctcagagtttgtcttcttgaattgggccaacaagaaagtgtctctgaggattttatttcatattgtagttcctggggagaatgtggtaactattttccttatttcccaataaacctattgaggatctacagctggctccactctttaggcccacttgcttctcagacttaaaaaccagaacagccccttgtccacagcagaaagggacgtgagccttggtggctgtcttcttttttgccaacaggtgctctgagaggagagttaccctttctgggtagcaccctaacacttgaatgttgataggtggcttttctagttaattccagctgaccccgtgaaaacttaacgtttccacttctaagtgtgttcatctctgttgctgcttgttggcatctcagtgttaagtcctgatactgctaggcttctagatagtactggaatggaagaccctttgctcaagtagccttacctaaaaagcaaaatttttataacatttttgaaatgtgaatacattttgtctgctctttaagggaaagacaaacccaagggtgttgtgacttaaatggttttataccaagttgctgaagactttggatacttgctgggtgggaagtgagggaagttatctcatttcagatagtcccaaaccgagccatcagtttaattgcgtaagacctggtgagccctagctctatccaggccacatgtgtaagccagaaacatatgttccctttgaacctaatggcctcaagagtcagtggcccagatcagaggcaaaaactggcgatcctcaagccaaatggggcctgcagatatgtgaaatcttttcagttttttttttttttttaagtaataaagcaaccctgaatgggccaaacaaaacatgaattcagatcgtgagcctctgagaagacgggtctgcactggcccttgtttcgggggacaagaagcaaatgcccctttaggtgtgcggcaggcacttccgtgtcagccttgttacacacagggcaggctcaccagccctctcttacttgcttgtcctctaagctcttgcctttgtggtttctgagtatttctctaatatcccttcctgcttcacaactcctgttacctatgatgatacaaaagttacagtcatcgtaaactcccagtatctttacacccagaaacaatatttccatccccctttttatgataatctgctcaaaatagaagaaaatctcagtctattaagtcctttttctaatgtgggagaattctctcaatttctagattttctttctcaagtctaagttgggatttctgggtacccattaacaaatacccccaggcacagacaagctcacacttgagttcaatatgcggtttaaagcattaccaccttcagtctttatggtaacataatctctggacaaattgcttttaattcaggctgtacccatgaatacagaagtgccattagtttcaagtgtagtttgacttttatttagatgaacgtctctgagctcacagtgaaatggctctcagctctaggttagtattgattgaaatgtctctggagtaagtttaaaagattgttgccacaatacgtgacactttctgagacagactttaaactcaaaattagtcgtactgttaattggcagtagtgtgagtggaattaatagctgagatgaaaaatgttaacctctttggcaaacacggggctgggtagactttggaggcaaggaaagattactttctggcaaagaaagttagggcccatttggatcacatctttgtggcttctgttcctgaaagatgaagctgctctggttgagattgtggtcccctaacagaatagttgcccagcttgctctttgtccgcctctaagggtatggctgggttatgaagcagggagagttttaattctgaaccattgacacagacgccatcatcttgagaaagctgctcatgtgaggctttccctgcctgtggttaacacgaacaagaatttccagcaactggcccttttctcctgtgtgactgtccctcccggtttattcagtgtaggtgggaatactgtgttcataagtagccttatgattcaggatcttacagtgtttactttctaaacactcacttgaactttgactatttgtgcaatttttagtcttaagctcttgtgtagaccagggtttttcaacctctgaatcctaggattgacatttagggccgcgcagttctcagtcgtgcagggctgcctgtgcattgtaagatatttaacagcatctttggcttgtatccaccagatgccagtaacaccccccactccctgccaccagttgtgacaaccaaaaatgtctccagacattgccaagtgtcctctggggggcaaaatcatccctggttgagagccactggtttagacaatgaaggggttttttcccttttctcctttactgctgcttgatgttgatgctactaaaacattaatttaaaaaaatgccgttaagaatagccttgtacttgatagggtgcaaagcatttggaccaggacaccttaatgtaggtagggagctggtttaccttagaatttctttccaagttgttaaatagtgaaatgatactgatagaaattcgtttgggttttcatagagttgcttggagtgccttatttatggatgtaggtggggagggggtatgtctgtaaatctcagtatcaatacggttacttaatacatgatcatgggatgggggcttggatttgagggtgggggagccaggagaagagaagatttctgaattctgggtatgatgccaggttgttgattccgtttttttctctctctgtctttaccagaaacctgagttacaacaaactctctgagattgaccctgctggttttgaggacttgccgaacctacaggaagtgtgagtctccccctaaacctctggtggatggaaggatggagagctctttgggaaaatcctcttgtattgcagcatcgctcactcccctagatccgcagtgtaaacttgtaggaaggaacatttgtgtatggactgtgttgatgaattctactcctgcttatctctcccttactgtaggctcttgaagggtgtgttacaattcagtaggcatagagctcctggaaatcctgggcgcatggtgggtgtatagcagagtccctccattgtgggaagccttgtaactggagtgacacatcctgggctggtactttctcacagttcctgcaccaccacgcccagctaatttttgtatttttagtagagatgagattttgccgtgttggccaggctggtctcgaactctggcctcatgtgatctgcgcgccttggcctcccaatgtgctgggattacaggttaatcagcccactcaacagtggcatgtgagccaccaaacgtgtatttcccaggaagtgaagttatagaaggatggactatagaggcttacctgttcctctccacctccaaacagagctaggtatgactgcctttggagctctaggcttgctgtcccttgcagtgtcttggaaatcaggctgcagtctttccttctttttaatgcattctgtttttgatgtggatgttaggattatcaggaattttagtttcatggagactttatagaaaccttcacatatatgtagtatacatattgtagaaaaattggcaactacagaaacgtgtgaagaatgaaaatcaccagtattctcacccaggcatacccattgtgaacacctagtgaaaactattacatgtacatatgtaattttaggatcaaactgtacattgtggttttatatcagtctttcctacttatccttacataagatactttatcatgtaaattaaaagtttttgaatgtcctgttttagcttttatgtaaaactactatacgtggatatttcatatattacctacccagtacttcattattatttttattagacattattaggtaagttttttacccatttttgttatgagtaactgataaaagtcttatttgttgttttttgtttgtttgtttgtttgtttaagacagggtctcgctctgttgcccaggctagagtgcagtggcgtgatctcagctcactgtaacctctgcctcccgggttcaagtgattttcacaccccagccttgtgagtagctgggactacaggtgtgtgccaccacatccagctaatttttttagtagagatggtgttccgccatgttggtcaggctggtcttgaactcctgacctcaagtgatcctcctgctttggcctcccaaagtgctggggttataggtgtgagccattgcacccaggcttacttgttattctttgattccattattgatgacatatctaaagaaattttaatttcatcagctggtacaatttgcaaaatacttgcattccaaaccctcatctccagattctccagattggcgtttataatttctgcttctgtttaaaaaaggtttaggcttccacagttaaagaagcatcagaacaggaaggggccttggaaatggtttctctaggactctcattctcccagaggatcagtgagtccatggcaggggaaaggaagtttgaagtgggtcactgtgttagtttgctaaggctgctgccataacaaacaaatagcacaggctgggtgccttgaacagcagaaattcatcttctcacagtctggaagcaggaagtccaagatcaaggtactggcaggtttggtttcttccgaggccttgcactgtgccctcacgtggtctctcctctgtgtgcattcatggtgtctctgtgtgtgtccagatttcctcttcttataaagacaccagtcatattggatcagggcccatcacctcttcaaaggccccatctccaaatgcagtcacatgctgaggtactaggggttagagcttcagcatatggaccctaggggaacacagttcagcccatcatagtcaccaagatgataaacccaggccatcatggagcttgttaggtttgtaacccagtgctttccctgatccaagctgtctttaatgcttgtggttagaatatattcaaattctgtgtacatctccaaacttagtggtttcttttaggactggacaaaattggagaattccctctagcatcattcaagctttcattgaatacttactcgagcatctcctctgtccaggagctattctgggtgctggggctacaagagtgaacaggacacagatagggctgggactggggaggggcaagtgaggcacccaacacaggcgcaaaatttatggggacaccaaagactcagcagtcaagataaagggtattttgatacaatattttgaaagtcaaaatgaatgtaaaaaaaaaatgatgagtaaaatataaaaagcttagatcaagataggattagtattactgatttctttccttttgccttcagttccaggatggcttcacacggtgctgttgctgattttgtcttgatttaaacttttcatattttgttcatcatgaattttgttttgcattcatcttcatatttaaaaaatattgcattaatatagtctttgtcctcgtgactgggtttttggctgtcccttaaattttgtgcccctccctacccaattccagccctgcagacaaacctctcctctcactgagtttacattaagttgagggaagccatggactgaataaggaaaccagtaagacttattggagataagtggtatgggggaaatagaacagagtaatgtgggagtattttttgtatgaagaattttggaggcttgataacggaaacagtgtgatcaggaaggtcctgagtgagcaggtgtgaatgatgaggacagggagcactgcaagtacagagcctcaagaagggaacaggctgaggaccactgtgcctggcatgcacgatggaggggtgcgtggccagaggccaggtccttttatggtttcaaccctcactgacccctatctatcaggggcaggcatggtacatgctctggtgagcattttcagtggtgttctaactccctgttcctgttgttccttgcctagacaggcttttacctttcatttgatttggctcccgtgacctgcagcctgtactcagcacttgttagagtttatgtcccacccagctctagaactgagcactcccacctttccttcattggagatactggttatgagtctcaaaaatatatttctcacttaggaacagtcacagtaattgtagcagtgtgctaataaacctttggagaatacgacatcacttaaccctaacatcaactctgtgatataaaacattatcttttttttttttttttgagatggagtttcgctcttatctcccaggctggagtgcagtgcaatcttgggtcactgcaacctccgcctcttcggttcaagtgattcccctgccttagcctcccaggtagctgggattacaggtgcctgcaaccgtgcccagctaatttttatattttagatagagatgagatttcaccatgttggccaggctgatcttgaactcctgacattaggtgatccacccgccttggcctcccaaaatgctaggattagaggcatgagccaccacgcctggcctgatataaaacattttctttctttcttttttttgagatggagtgttgctctgtcaccgtggctggagtgcagtggcgtgacctcagctcattgcagcctccacctcctgggttcaagtgattctcatgcctcagtttcccaggtagctgggattacagatgtgcaccaccacgcccagctaatttttgtatttttagtagagatgggatttcgccgtgttggccaggctggtctcgaagtctggcctcatgtgatctgcctgccttggcctcccagtgtgctgggattacaggtatgagcccccacacccagccccttaaaacattttccacccagccccttaaaacattttctttgtaagcattttctcagctgggtgcagaaggatcacttgagcccaggaatttgagaccagcgtgagcaacaaagtgagaccctgtctctacaaaaaattagctggacatagtggcccatgcctgtagtcccaggttcttgggaggctgaggcctcaagatcgcttgagcccaggaggttgaggcttcagcgtgccatgtttgcaccatgcactccacccaacagagcaagaccccatctctgaaaaaaagtaataaaaataaaaggagtttctctgctttgcagaagaggaaacagatacttagaaaagttaaacttgcacagtgtcacatggttggtaaagctgagagttgaactcaaaacctgtgctaaccttggcggctgcactaccttaaattcctatatccttcatcttaactctcacagtcaactgaagatgaagaggaactgaggcatgggatttggctgaaattgcgtgattagtgagtggtagaacttgacccatgttctccagtataatcctggtccacaccatctatggcaacagtaccgtctgagtgtgggggatgttaagacagaggtcatatcttagggattcaatatgatgtggtgggaaaaactctcattttggtagcaaatagactcacgtttgatttctggttctgccccttactagggtcctgagaccctagacaagttacttagtgcctcagcgtttgctttctttcttctgtaacattgacatcgtaacacattgttggtgttactgtagttattaagatgatgcacagggccttgcacatgcgagaggctcactgaatattatccctcttctctcctgctacgtttggaactgcccagccctccaagctgggtgcattgtttagaaatgaatctttgcaggctgactggttgaatgtcttaccattgtgcctcctatccctagtgtcactccctgttctgtgagatggatgagatgaattccctgctgcctagaacagtagaacttctcactgataaaagacccaggccttaccctaagggaattctaaaaagtcgtggagacagaaagaggctgttaggtgttgaggggtggggaggtggggaaggatattgaagaaaagaaaaaaaatcgtagctgacatgctactgcttcaaaattaaccagtctccagtgttgcccaggcgctgtcagctctcccaaactttatagagccttcagtctggagccctcattgagaatggagccacaggctggcagaacagcaggcagtggtttagcagtggttttattctggaggcctcagaaccacatgacatcatgggccggctggagagagaaggcgaggcccctggaggacatgaggacgcttgtgcagctgcgtccaagccacacggtcttcactgcccacagccctgaggaaagcccaccagggagtgcctccagctggggtcctggccagcaggctcctctattaataaaaggggctatttatacagtcctctgtagatactgccttcagatcacagtactgccgcctggcccgcgagtgcctgctgtgggtgttgccgtgtgcttgccagggccactgacctggtaaggaagcctcaagtgtgccctgcctgctattgggtatttgtggttcatcgcactgtgtcaggctgctgctccccacagtgggtgtgtgtgagcaggggtgcgggggatggtagtatgtttagggagagggtaaaataatgagggttgtcgttttggggtactgccttttggctgtgaattactatcacttttttttttttttttttttaagacaggatctcactctgttgcccaggctagagtgcagtggtatggtcatagctgactgcagcctcaaattcccaggctcaagcgatcctcgcacctcagcctcctgagtagctggaactacaggcgtgcacaaccactcctggctaattttttgtagagatgggttttgtcatgttgcccaggctagtctcgaactactgggcttaaatgatcctcctgccttggcctcccaaagggctggaatacaggtgtgagccaccatgcctggtcctcctgccatctcttaagcatatcctgtgtatctgtcaatatcctgagatcttaggtttaattatttcagctggatcctcccaaaaccctacaaagctggcacttgtattatttacattcttcagaagagggaagtaagggacagcaaggctgagtgacatgcttagcattggattgataaagggtgcaattggagttgagtgaaccaagatatgtctgatttaaacatctgagctatataatcccatcctaataatccctgttctgtaactgtgcctcagtttcctttcttaaggagaggtgataatttagtactttcctcaaagtgttagcatgtcattcactgagatattgcacatagaaaacttaggacagagtctggcacatagtagatgttcacctttattattgtttattttgttaaagtaattatatcctacgctaaaataattttatctggctatcttgtgtagaaaccacgtatcataaagtctcaccacatcaattagttagtatacattattctctagtaactaaagcagaatacagttattaagtggccctgcttccgaaacccatattcctatgtgatactgatggctttcacccttttaagaaacaaaaccaactacagtttcaacgcactgcccaactttgactactattaattgcagctctgtctgtatttgggagcaaccaaagaaacagccactatgtctgccagtagtggattggccagataaattatggtccattcataccagcagaggactactgtgccaccagttaaacgaatagtggagacctccaagatatattactaaagagaaatggcggtacacaacagtctgtttaatacacgtacatttgtgcaaaagaaaaacacatacacatctctagtagccagcagcaggagctgccctttggaggcagaccagaggatggaactgcaaagaagctttatgtttactatgtattcttttttgaaatggtttgaaaactttactctgtgcttataccagctatttaatgagtaaataaataacagcaagaaaaattcaggcatggtggctcacgcctgtaatctcagcacattgagaggccgagaagggcggatcacctgaggtcaggagttcgagaccagcctggccaacatgacgaaaccccgtgtctactaaaaataaaaaaattagctgagtgtggtggcctgtgcctataatcccagctactcgggaggctgaggcaggagaatcgcttgaacccaggaggcagaggttacagtgagccgagatcatgccaatgtactccagcctgggccaccacagagcgagactccgtctcagaaaaaagacaagcacaatttctgcattggtttgacattgttgaagccaaatttgattaagattgatgatgatgatgatgtagtactatgaaatagcctttatcacattttgtagcttacaaaatgtaaaacttcccttaagtcaattaaatggaagttttgggagaaaggtgagggaccagaaggtccaagctgaccttacggattgaattgggaaaggacccacccctaggttctgccctggggtccggaatccttttaccttagctacaccttctctagccccagggtctggccgtgattcatgggtctgatgcatctgaggcacttcttaatcctgaatcatcagaaaaggtttagaaatagagaccagacgtttcagagagatttttagggccttggatggaagtaaattgtggggagagatgggcgtcggcaggggaagtaaattggcgggtagggggtgagagaagactgtacaatcgtagatatttaaaaaaatttcatcaggcacaatctttacttcctaaaatttctttattcatggagactctgctaaacttcctgagtgcctttcccctcaaagctgtagctgtgctatttttgaccagtctctatttcagtctggcaagaagttctttgcatctcagagtgagctgggcctctgctgccttctgaggagagtattcttgtttcaacaggggacagagtgaacaaaaagggagccagcagtggtggagctaacagacttactctgaatagcggttcttttttcagtagaaatgatctggaagtaagctcactgtgcagggcctctcctgggggctttgagtgtcctccctgtaagtcaggcagccctgttgccaccagagcccactgtttctgactgagcccttgactcgggcctgctcatctagacatagaaggcccagttaagctccagcactggtccaccacccctctatgctccacttccagcagttctgtcacaatttgaaatatcatgatgcccgcttcccttgttcatttatttctgtgaaattgggtggagcagtttgtcacagatacagtaggcctggcctgagaccaggctcatcaggcgtagccccctgcagagaagtccatacgctttgtttcaggtttaaaatcaagtgagatcctaagctggctgaaaaacaactgtgctgttacctaagggattatgagctttccagctggcctttgagcccgctgctctcctctggtttgtagtcatacttttttcaggtcttggccatgtcctctctagtagcatgaccctagatgagtgacttaaactggcctagagaacttaccggtaatgtagagaatggtagtagttaacctggtacctgattcaaagttgttgtgatggtgaaagtgcacgaggcatgtcgagtttttgctgaaataaagaaatagaaggtaatgaggaaaaacctagactttggggctaggcaccctgggccactgcaacttattgctggtgaccttggtcaaattacttaacatctgtgtttcagtttcctcattggtgcagtggaaatgttcctgagacctacttctgagggctgtagagatgcattaatatactgaaaagctcttagagctgtgcctggcacatagtcagccttcattaatttacctgcttttgtttttgttactaacattctctgtgtttgagaagaaatcgcaagcaatgaaagagttcttaggcaagctgcctgattgacagcaggtccccgaccttagtttttcttgctctgataaaacctgggggtctcttgtaataataggtacgttgatgggtactatgaaaaatttattagctgagattaagactaatggggagttttcagtgtccctgagtgaggatgggaaatggatcacagcagggttggaggagataaaaggtgaagcagaaacaatctgatttagggggcagtcagataagagactgttaaagtaattaattgtctatttcaacacacaaacaagggccctttaagtggagaaaagatttgccacatgatacggatctgccttctctctgccagatgcttcagccatgaagctattgaaacaggcattctatgtcccacagcccagtaattgccaagcttcatccctaactggctttggcactgaagaaagcaaatgggataattcaaggcctttccttttttttttccttctcctattcacttctataaaagatggcagacaaccagattattctcttcaagcacatgctagctgtatacttgtatgagtacagctgtgatttcagttgctttgtcttcaaacagaaacaggatgctctgtgttagacgtacctcccttaaaaaactgagaataagaacccagttttatccccttgactttgcatcgcaagtacaatttctttctagcccatcacctggcagaaagcctgaacactttgctttggttttcttaaggattgttgggctcactttgcaagtctgattttggattctcttcccagatttggaaatacatgtccatgtaaggaggccagattgcacagcctctgggggcagaccaggcgagccgtgctttggttcgtgggtttccccttccgttaagagatattaactatggaaatacatatttggactattttagcaggaagggagcttggagagcaactctcgtctgtggagaattttcaaagtgtctatgcgcaaaagtgtgtgtatatatgttcattttcctgggggatgcatccagaggcttcatcagagtccagctggaacctcaaatggaagagagtctctgagtccagttcccttgttatttcacagatgaggcactgaaataattggccccatgtgtcccaagcccctcagaactccatgtgagccagggcgtgagtctctggctcttgttccacacatgttgccctttgacaggggcaaatttcggcccacggggagtgttctcaccgatggtcttaggggcgcttttgtcccgaacctgcctcttggcttgttctcactgttccttgtcttgatttctgagtttgatgggaagctgatgggagacaggagatgcttccccttagtgtttgtttctagccatgggtgtgatcagtggctagtttttgtgatctcatgtgacttctttccctttaaaaactcactgctaaattctttctcttttctccaacattagaatataggtttactgtggcagacttagcagcgtttgtttatttctgttgtatgtgtatgatttcagactaattcaaatgccttacatgattaatttcttgttgttgttacaggtacctcaataataatgagttgacagcggtaccatccctgggcgctgcttcatcacatgtcgtctctctctttctgtaagtggtgccgtttgggggactctgggctgtgtggtggggccatggtgtttgttgccttgctgatacctggtggcaggataacttgagttcatgtgctcgctggtgaagaaagacctttcttcatgtggccctcatgatcatgacaaacgctttgcttgctgttttgggatttgcagaattaaacgctggaagttttacctcatctttaatttgcaagaaagtaggtcttttgtcttttttttttttaatgcgcagaggtatatggaactagatttcttgcttctgtggttggttaagctgcaactttgagtaaaactggagttaaaggaagctgtgtcagttataagacagcaagctaatctttgtgccagtgaattgggtaatgtgactcagtttacttttgtggctttaagaaaaagaaagtgcccccaggcctctggaatcaacgtaaaactatgttgtcatggtcaagtgttagataagatgcgatctatttgttctagacagcacactggaaatgaaaaagcagatgaagggccttagctaaaaagacatgaaggcacccattgggaatattatcatttgtgctgttacaaacctttgctagagaactgagcactgatcctacccctatttcttcagcagtcaggtggaggagcttgcttgttttaaactcacccagaagactttccagataaaccagccatgagtccaacagttttctctgccagattttattggcagcttccccagcagagcacctccctcttcacactgaatttcctgtttccactccaggctttcatagtttaattttattttgattttgctggttttataattagtttgctcacctatatgaatcttttctcaatactgaggctcggcaggctgagcagagaaactttgcaagaaggtgctattaataagagtgctggcatagcttacagatctcggatctttggctggcagcatgccctgtgttcaggaggtgctgtgtccctgtgaaacatggtcttgggtttaacccttttcatggcattgtgggattgcaggagagcgtggggggttagaattgcacttcactctgtgccctggacagatgacctagtctctctgaacctcgtttccctcatttacataatgcatttttgacccattttatacatgaggaaagtgaggcccgggggagtggaatgtatatgaagctcccagcattctgtgggagtgtttgacaaatggtggttactgtcattggctggtggctagttgtcacgtagctccttggatcttggcaggatctcacctttaaggccgcaggatttaagagtcagtctctgtttctgtgaagtgctggaaggaaggtttgtggccctttgttcccttgatgggtaaaggtctgactttattttgtacccacttggtttgtgggcccagcatctggaaggtgtttaatttttggcttaatcaatgagttcgtcttatgtgaggctgatagggatgtgataacctgttgtgtgtccataaagcaaagcacttgaagatgctaggagctccttgctgcttaaagcacaggtcatggaccatcagtattgagttagcttcgagcttgttagaaatgcagaacctcaggcttaatgccaacactactggatcagaagctccatttaacaagggccctggccgtttgtccacgagttcaagtttgagaaatgctgatgtaactgctcttgttcctcacatagtgaggaagctagggccacagagaatatctctgtgttgtcagagaggaaactgagcctccctggaggtcttataagttgtaaaagtgagaggtggaactgagaccagacacaaacgcctttgcatcactcctttaaccccatgcactcggggcaggagcgtggcaggtgactctgaaccacactgtgccagaggcaggcagggcccccagtttgccccacgggcctgtggcacttagaattgcaccttgctctgctgactaaaaatacatttctgttccttggcccaagtgccaagagaagtggggctgtttggccttgttcctgctattccattagacagcattgaagtatgtaaagcaggagagaaaaaaaagagagttactccctgtttggattcagtttggaaaatgcaggttagcactggcagccagctctttggcctgaagttgggcaccatctgacttggtcagtgatttctctgaaatgacagaaaccgaaggggctttatcttggttttctctgaggtgcctgtgttccccattcttagattggatgcctggattcagtgctggcaagttaggttagcagcatgacatctgggcagctggattattgataatgcttcatgccttttctgtatttcccaagtggaccgtgcaaaggacaagggagaaaacaacagagcaggcagtggatgagcatcattttacagcccaaagaaccaccttcctcatcctaatcaatgaaggcagaagacttagcagccccatccacatgatgattccagtcatccaggttttgaacagcaggttttgctgatgtgtctcttacttttcggaactagtgaactgaagggtgtcacgtgttctgtaaatatttagtaggcactttttgtgtccctgcagttgtggcccagaggctgtcccagggagaagcagaagcctcaacacatcgtctgaaaatgtggtagttaatagttagatgcttatagtccttaatcctcaaattcttattccgtttttgtgggcagacagaggatcagaaaaaaataatcaaaatatgcagagagaatagagcaaatgtctgctgaggccatgtgagtgacaggagcccagacaactttcttgggacaagtttataggtagatgcatcacagaaaagtcagggctaggtgtgggtcctgctgtctctaatgtagttgtgacctgggatacatacgttactttttttctcagatgaggaagttgaagcagatggtagaagtaccctcgaagcttgtgtattctctttgtgacccgaaagttgagagtaggggcaataatgtcacaaaagacatagttaccctctgaccaataaccactgttgttgctttctgtcttttcacagaagtagtgggtttgttaattttcagcttggacacctataattatggacttttgcctctggaagttggccctttctctctgtgtttcattttgcttatgcagaattgagccgacttccagacaccagagccctcccaagctgggtggcaccattgggagagcctcatgggaagaggcattgctctgcacctggctttttctgtcaggtcttcaaaagagacttccatagttttgggaactggagtcatagagcaaaatttcagttggttaatactttctgattaaaggaatctaattcagttaacatatttgtcaaagaacagatttatttgcattgtgttctgaggataatgccggagccatttgtccttaataaacagaaagcatagaactcaaggaaagctcttaataagaatgggttccggtgagggagctaatttcataaaatagtgccgagaaaaagaaacagacttttgttaaatgggggcagaagctgccagtggattttcacgtttgagatttctttcttttttaatttaaaatccaggacactcaagttacgattcccacagcaacagtaattttgtctgatgcatcaatgacatttctgttgaggaaaaatctctgtttttccggtggtgttgctgcacttgtactgtcgagaagattggtgacagtggaaatcgttgaatttttcagtcctgggagtaaaaatgtatgtggtatagttggtcttagcttttgtctcctgtgcatggactgtagcatattacccatagggttggccttgtctacctaacaacttctccagctggtttgttctagacttcatccctttatggtgccttgtcatttgctctcccacagcctgtgtcctcaaccaggaggaagacctaggcaaaacttaggggcacacaattaattgtgactttgtaatattgctattaaaattccttaggtttaggttgcatttgaaaacacattgaaatgccttttacttctaatcttgaaaaaatgtttttgaaaactattttttttaatgagataagataaatgtacccagggacatggggaggcagtgtggggctggtcaatgggtacaaaaaaatagaatgaagacctgctatttgatagcataacagggtgactatagccaataataacttaattgtacatttaaaaataattaagagtgtaattggattgtttgtaatacaaaggataaatgcttgagggcatggatgccccattctccatgatgtgatttttatacactgcatgcctgtttcaaaacagctcttgtacaccataaatatatacacctactatgtactcacaaaaaaatcagaaaatttaaaaaaatgaacttaccattaactcaccatttaaaagccacttgtagtacgttctcagtgttgtgcaaccatcaccactacagaatgctaaaacattttcatcaccccccaacccaccccgccccccaaaaaaccccatactccttcaacagtcacttctcatatccctcaccctagcccctggtaaccacttatttgaaaactaatttttttttttttgaggaaagcatttttctctcatgttaacaaatgaacctggaagacttcatttataaataacttaataaaatatctgaggtggctttaactatattttgctgtgacctcttagctgaagagaagtgattaaatgaaagggataggaaggccgggcatggtggctcacacctgtaatcccagcagtttgggaggctgaggcaggtggatcacctgaggtcaggagttcgagaccagcctggccaaaatggcgaaactccatctctactaaaaatacaaaaatcagccaggagtggtgggaggtgcaggtaatcccagctactcaggaggctgcagcaggagaatcacatgaacctgggaggcggaggttgcagtgagctaagatcgcaccattgcactctagcctgggagagaagaacaaactctttctcaaaaaaaaaaaaaaaaaaaaggcgggtgggcgggagaggataggatacttaacagccctctgttgtaatttctggagaataaaacttggaaggaaagaaacgcggtgtcctacctgtgaccaagcggggaggtggtcaccttcccccttccccgggggtgagtgaagagtggacgaagccctgggtggggttggagggatctgaggcagcaaaggcctgagccctcttcttggctggatctgttggtgaagtaaagtcaataggaatacttaactctctgagtacctagcaaaccctctggaaaaaaagaggggcgaaatcaatcttctttacaggctcgttaatgcaaagatcagttcgcattaaagtgtaattaaagagtgagccttagagagaggcagctgtgatctgctgcagctcagggctggggggaataatgagagtcccttagaaggcccaagctggaagtgacctggagtgcaacgtcggaaaattaggctcggcctcatgatctgagctaaggttgttaataatcaggcttgaagcacaggtgagattatactgaggaacaggcagcggctggcattcccactgcatgtgtgtgtggggatgggcagacttattctccatctaaggagctgggttgagacgtcttgtccttctcttcactgcctgcctttaaaactttctccatgttgcatctcctgaagaaaggcatccttcactggcataataaagaattgatgtgaaacatttttccatgtgatgtttatctttggagggatgaaataagaatttgtctttaaaagttgagtggtaatctcagatggtggagctctttgtgcatttattcctagctggacctgtgggcaccataggtgtgtgtacagtcgaggtgggcgtagagattctccccaagaccaagggttgccccatccttccttcggaggaattatctgctggtccctccaccagtcaccagattaagagtggacctaatcaagggtgttagaaaatatgaaaacaagtatataggtccccatgctactttggacaggcttcccccgcgtagcaacctgatttagctttactattgaaggatggccagtccgtttgggtaaaagtaaaccttactttaaaaaaaaaaaaccttacttttaccatttgggtaaaagtaaaccgtcagtgtaaaagtaaaccttacctgggctacaggcattttattgctctggcaataaaatgaattctcattaagagtgtggagttaagagtgaatgactccagctactttaggaagaaaatgtgagcaaagctgttttaaaaggcccaggctgagttcaagtgaatgccttttgttccttgggtagtccgaagctgttttggttcccagatgctaaagggggaagatacaggcctagtcaaaaaaaaccagcacaacagggaggaattatatatatacacatacatatacacacgtatatatatgtgtatatatgtatatatatgtatatagatagatacagatatgtgtgtgtgtatatatatatatatataattatctaaagttctggtcctcttctgagttttcaaagatgtgttcacttccttccctgtttgcacagatttttgttgatgtgaactgattgtttcttctggataaaacctcatgccctttcccttgggagatgccagcctctgctcactggtagaccacctgtagggcttgctgagacacaagtcactgggtcttaccctcgtttctggcttggttcaacgggtctgggatgggacaagagaatttgctttgctcatgagttcccaggtgatgatgccactgctgctggccaggtggctttgagaaccactcctggggctcatatggggctggggggagccccaaggctcatgtgtcggttctgaccaagctgtttaggccttgggggacagtaaatttccactcctaatgtcaccagtgtggtggcaggcatttgtttgggacagtggggctctatggccctggtaatggcttctgagaaaggctctggggcagtgggcagagtgagctccagtaccacggacagaacagacctgggtggctcagggttggaggcccatgactgttacatatttgcttgtgcttaatttgctgtttgttggtgaccactcaagtctgcccagcagaccttcaccggctgctgtagaggtggagagcgcttcgtgagcagcccaacgtggcaggagccctgttactctctcagccggtgggtgctggcagctctgcttacaggtgagcatcccctctcccccggcaggagtcagttttagcacacttacctttcttttgattatcagtcactcgtatctgatcagtctttatcctcagctaagacttgaatgccacctctttttccagatggaagttaacaggcgtgtctgaaaggtgggcattttttcccccaccctactggggtccccacctgccccattgccctttcctagcactgcattgtttatgaccagattactctcctcccattttcccagcctgggaactgtggtcaggtcaacagtgggcaaaagagatgaaaatgtggaggaagtctcagctggttcatggtggagaccgtgggttcctctgcacggctgctgtgaagttggccagcacatgccccactcaaggcctttcgtgagcaaacagatcgggtcctatgggcctggagttactgccctcaaggaactggcagtctagctgcagaggaagatgggtgaacagacagttgtcatacaggggctggggaatgtctaaggggcacctcactgcccgtcactgatgggtcacatgacagagaagtttcccagatgaagtgacattttagctgaggctccctgttctgcaaacctcctttctcttcccctacacagaggtgtaagttacaggtgtaagtaacaccctaaatgttcagccaacacagtgggtacttggaggagcattcagaggaataccaaaaggacatggctaattccatctttaggccaatttgtgcacacacacaccccctcactcatcccccgccccctcactcatcccccgcccctcactcatcccctgcccccaacacataccctcccttccctgccttttttctttttcaacaggcgggcttttatgaagagccagcaggccgctgttgcagttcttagaactgcagcctcatcagatgctggataccaccaaggagcctcaaaatagaaaattaaacacccaatttacaaagaaagcagctctctgtcccggaaacttcccagggattccgtagtgcagactgccacttgcccccagtctaagcaagcctttcgctgggaaaagagctgctgtggcctccgcagccagcctgccaaattacacagtcatgacttgtcattttccttctctcttttctttccttttttctcctttctttgagagtgggggtggtgagccagccagatgagaggtacatctgcaagtcatttgctgagaaagtgaagggaacaccagctgtggggttgggggagccgaggaaggggagatcccatggaataggagcttggtcacagagatcactgcctcttttggaaactcggtagcttttgttgagcgtagggcttttttcctttccaccaccccgcccgcctctttctctctttctttcccttttcctgatgaccatgcaagctttaaatatagcccaagatccactggggacccgggttgctccccaatgttggagaagcagtggatggtctcggaggggaagtgctgcttcttccagcagtgagtgctgaaaaccctccagggctgcttgaaatggagccgggaagcggagctgctctgtcattgcacaatctcccgtgtgaaaggggttggctccagcccatatcaacagtctcattccaactgggaccatttcctcctcctcctcctcctcctcctccccctcctcacttcctgcaggtggcttctgtaatccagttaccactgggaagcctcatgtgcatatgcacctaatctgaaaatggctggcttgactttgacctgtgtggtgaccttgcagagaaggcagggcctattgtgtctgctcacacctgggagccattttcagcttttatagcccaagtggaagaaatgtgtttgtgtttatgccgggcctttccttcataaggcctgtcattgttgggccatacatagggaatattggattccccctgcttgtttaaaggcaagagtttttaaagatagaatagttgactcagtatattgagtcccatgaaatcactgtttgtgttttgttcagtagtggtcagacatcagcaatcttgtattgttcagccttttgagaagaaaaaatagtgaccgtcagcatatatggtacactgatattggcaggcgttgctctatggacttcccgggacctgtcttactgtgtcacctctgcagtcctatgagacacaggatctgttaagcacaatttacagatgaggcacctaaagcacagagacggcaagtaacgtgctcaacgtcacagagcaaggaagcatcaaagttggatcctgttatttctctccatctctggggcttatgctcactgtacacttggaagtatgtggtctgggtgcctagaagggtcttgtcattttaagtgctgacatttcaaactgtactaggtgtgggaagccttggtattgtggcccagaggcttcgatgatactctggagtgtggagtcagaggctcctaccctgcaaatgcagcatgcatctcccaaagtggtgctgcgtgcctctgtaatgcccttgctttaaaagcctctttctgacccgaggtgaacttgctttgggtagctcttggtatgattttctttcactgatgcgaagtaacagaaggtccttccccctactatctttccctgtctctctctctcatgtcaattcagagctgattatgccggccatctgtgaaaggtacagtgaggaaaaacactcttgtcgtcaggtctcggcagagcccaaacgtgttcgattgtgccagtagattctcggatagtggctatctgcccccgaagacatcacttcaaggcaaattcctctgcagtttcctcacttcctggatgcctttcaaacccaaacagctgaaataaaggtgccagtttgtggttttttttcttcccaacttcatcaaccaggaggtgaaatgtgtgctgtgaagtgtgcagccccagaggtactcatgggctgccctctcaggggccactggcttctgcccaactagctgtcctattgtagagtctctttgggggctctgatactttttttcctcggggacagctgctgtgacgttagtttgtaaatagcagggctccttttccacgtagcggtaggacaaaggtaggtacaaatggatctcttcaccttacgctgattcaggcatcatgtgggctttatagagagggggcatttttgcacagtggttaagagaaggctctgtatccatcagatctgggtttgagtcctgcctgcatcacctttgctatgtcacctgggcaggttctctcaggcctcagttttctcactcataaaatgatatttgctgataaggtggtggttaggattaactaaacagtatgtgtcctcagtatagtgtctggtatatactgaacgtgcactgagtgttagacactcttgctatctctgacagctttgtactgagcacctttggggttgtgggcaaggcaagcctgcttttgctgctgtgctctgaggggcattgctgctgtctacactgaaccctggaggccgcctggtattggagactggagaggggtctatttacatcccataaaaatggatcttacttgcagatatccatcatggctcaccctcctataaaccagttgaagcttacagaaaaccctcgtatatgtatctgttcattcctcttacgggagctgttgaggacagcagcagagtttattttctctcctctcttgtcatcttctgtttctctacctggggtaggtgcagcaagcagcaaagtgctaggcaaatgtttaagcggtggctctcactcatagtagaatgacctagggagcttaaaaaaatctagatgtctacgtctcagggcagttaaatcaaaacctcgagttagtgggctggggagcagagggggtgagtgttgggcccaggcgttgtggtggttttttaaaaaagctctccaggtcatttcagtgtgcagccaaaagctttaataagccacagctggataattgcaactgaaaggcattgttcctcctcttgtctcctcccctctcataactatcatttaaaatacccaggctcccccacctccctccactcctttttttccccctctttctttctcaccaggtggaggggaaataaatattgaggctggccttcattttagtacttaggactctggggatccctagtagaggttttagtttacctcttttcactgttgatttaatttgaagatactgtgcagttagccacagcgtgatgaggaagttgctttggtggtgcgcgggtgagggtgtttggtctgattagacctgcccaccttatttggagatcacagaattcaactgtggatttgccccttatctgggtcattctttcttctgatagcccacccaactgtcatttgcattctacctatatgtcagaaatgtcccaccatgatggtggaaaaaactctctttatagtaaaacaataggcaaaactgacttattctaagctccttaaacacctttttctttataacttcaaaagtaagacttggctctttttaaaaaaaaaaaaaagtaaatagatgatatagaaactgaaggatctcacccaaaagctttattgtaatatagcaaagttctggtgctaaaattgagttggataattgtataatgggattttgtgaaggttgtgtttggaattggatgctaggttaagttgcaaagagtagaactttggaaatgagaaaaaaaattccccttggactttttagaatgtgacttttctgcaaatcaaatgtactttttataaggggaaaaacagtggttatcagcatgcatagtgaagtttttctgcctcgtaattgttgggttcttctcaatcggaatgagagctggcgtgttgagaaagccagcatgggcttcgtgggctgggcccggggaggccttggcgcagttcttccaggggctccccttccccatggccttgcagacagctgtgataaaccctttcaccacctggctttcctcacgggctaggctggcccctgctctgtcttcctctcctctagtgtgtgttaacgagaaccctgatttggtgatgctatagcaactatttggttccaagtaagagcccagtgcctgtcttcactttcccccattccctggaaaagagctgtagtccctgagagattcaatacgtcatcaaaggaaatggtgatatggcagagatgtgcattccctgccttggtggcctcatgggtcacctctaggaagagaaagccaaaaggcgtgagttgttggcatagtggtgaggaccaggtggcctctcacagcgccatccctttgtgggcatttcagtagagggcattggtccatttttgctcacctccagttgggtgctggaatttctgcagtggtatctctgctgcaggggaagccctctcaccgtcctcttgtcgggacgtaacccaaggctcattccaactcttgggaactgggaggaaacatcccttcctggagtgtacagggccttttcccccttgttagcaccagtagtgttcagaggaacgagtgtcagggcacttggcttgtggtccctactctgacattatggatccattataggacgtttcacaaaacacttctctttgtgacttctgttccctcacctgtaaggagaggggctggttcagtatcaaccatactcaaccagggttaaaaacacacatggctgcttccctactggaggcctgggctgtatgttctttggaacagactcacatccctagttgagaactgctgttgtgggtgaccctgtagttctggggccccaggttcctggcaggctcacatgtttatgaattctgtggagaaggccggctgagctgtgtgctctatgttgcagagtctgcgtggagtgggacagggggtagcaccctagcaggcccttcgggtccggtgccaaatctgggccctgcatctcatctctacaggggttccccaaggccttggctcccaagcatccagatgtggctctgaggcagccctcatccctccccactccacaccagccacccaatgaagtaccttcatcaatatttgacgaagacatgaatgaagggtcccttcgtggcttcccatcctctatgggacaaagtcccagctctttcagagttggccctggctccatttcttcctgttctcccacctctaaattgtgcgtaaggaaagcccacactgggtgtgtctctggatcctgtacctgcttcattttgctaccttgatctggaatagccgcccctcttctgacctcctccccccatgatgttgtgttcccctctgccactgcacctatgacatccctctgtctcctctggggctggggtgaggggctgatggcacagtagccacgtccgtctttccttgcagcagctgcatgtagcaggcatcccatccatgtatggatgaatgactctgagggaccaagtggaagggtcatcttaaggataagtgattgtggggtatggggcagacactaggttgttttagatacttattcaaggtggagagacaggcttgggcacgttatagtagaagtggcctgctgaggggtgctggagggcgtggctctccagccaggggataagtcttgcttgcctggatttactgaagaggcaggcagggtgtcaagggagaaaaagtattagtggaaactgccatgtgagaggccgcctggcccagaggtggacagggcttgcccccagggctcattattggggtttgagtcctggttctgccatgttctagcagcagcttttcaagcctctgtttgcttagatgagaaattgctcttaccttaccacagatgtgtcaaaaaagggctctcccagtctctgctcgcttgtttgaggggccagcaggtggtttgggaaaggctttctgtgaagcgaaggtggagagtcactgcagatccctgcaggcgtccagcccatgctgggagatgccacccgttccccactgcagagacggaaggaaaatgagggaggtgcagcaggctgcgtaaaagatgacattaaggagtgcctggattctagaggtgccagtagatggcattgagggggaaaagagtgctctgtgttcagaaagttcagaaaacccagagttgaaggtgagcacctttctttcctgcagaacatttcagagcctttagtgcttgatgttccctttgagtctccaaggacaagcagagatcttcctaagatcatttcatcatagctctattatgttttcattttctttcagaggtaggaagggagattttgggagcatgagaggtgctgacctagagaatgataaaatccactcctcacgttcccctggcagtagagagtgctgcttccctgtctctaaatgcacatccatgaagtttagacttcgctaccacaggcatatattcccccctcctcttcagttcttcctgtgcaggcttgtcacagtttggcttcatttggaggctggcaccagacccccgggctctgcgttgtatgtcttttgacctcaaatgagggggagagacgtggtgtttcccacagatagtgagtagtgagccacctggaatacttgttctgtgggatgttaatggtcgtttcatgaaaaggattttgtggtcatgtaagtttagcaaatgccaaagcaagccgagtgaaaggtgttgttatcatctctcctaagccgcttttctttgctgacctgctgagggagtctgcaagaggcgggggaggaaatgccccttcctgagcttgcctgcacccagcaccctttccatggaacacctcccaaggccagtatacgaaggatgatgctttgggagtgtggtgtctggcaacctgcgtctgccactttctgggcatgcacgtctggcacgtcttccttggccaagtagtgctggaagaagacacagggctggatgacaacccctgatgccaggcaagggccacgctagctgtcctcagctttatcagcaacacccttgtctctaggagtcccagccctcagccctttcctaaatgatgggaagtaattaaacagttcatgcatatccctacatttcagaaatcacacagagcccagtggtagttggtgcttggctctgagacctcagtcatactgtgtaagtttctgctggtttgaaggatggctggagactagtaaagtagcaggaaggctgattccactgggaactcccccagactttccatctgattccaccgtgaatgccatgacacttttgtattgttgttttaatgatacttagggataattgttgattcacatgcagttgtaaaaaaaaaaaaagtaatatggggagatccctcacgtacccttaaacccagtttctcccaatggtgacatcttgtacagcttttcataaccaggatattgacatcgatgcagtcagaatgcagaatatttgtatcattgcaaggatctctcccctttatggccacagtcatttacttcttgccctcacacccttggttgtcttttgttttctttttgagacagagtcttgctctgccatccaggctagagtgcagtggtgtgaccttggctcactgcaacctcagtcttccaggtttacgtgattcttctgcctcagcctcccaaatacctgggattacaggtatgcaccaccacacctggctaattcttgtatttttgttttttgttttttgtttttagtagagatggggtttcaccctgttgggaaggctggtctcaaactcctgacctcaagtgatctgcctgcctcggcctcccaaagtgctgggattacaggcttgacccaccatgcctagccccccctggttgacttctaatgtgttctccaaatttgtagttttttcatttagagttttatataatggaataataaagtatggataaccttttgggattggcttttttcactcagcgtaattccctggaggttcatctaggttattgtatgtgtcgttccattcctttttaatcacagagttgtattccataatatggatgtgccgtactttaaccattcacccgatgaaggacatctagaatgtttccagtttggggctgcttttaaaaaatactgctatgaacatttgtgtttgggtttcttttgtgtgtgtgaacataaattttcacttctctgggataaatgcccaggagtgcaattgacaggtcatatgggagttgcatgtttagtttttttaagaaaccgtcagactcttccagaatggccataccatttgacatttctaccggcagtgtataggcaattccgtttctccacattatggccagcatttggtggtgtgtttttttttttttttttttaatttttttgagacagagtctcgctctgttgctcaggctggagtgcagtggcatgatttctgctcactgcaacctctgcctcctgggttcaagtgattcttatgcctcagcctccccagaagctgggattgcaggcttacgccaccaggcctggctaatttttgtatttttagtagagacagggtttcgccatgttggtcaggctggtcttgaactcctgacctcaaatgatccacccgcctcagcctcccaaagtactgggattacaggtgtgagctaccgcgcctgaccgtggtgttgtatttttttaatttcagccattctgataggtgtgcagtgatagctcattatggttttcatttttatttgcatgatgaccaatgatgttaagcatcttttcatttgcttgtttgccacctgtagattctttttggtaaaatgtccattcatgccttttgcccattttctaattggattttttggttgttttttgttgttgttttgctcttgagttttgtgagatgtttgtatagtctggatatatattctggataccagttctttgttagatatgtgatttgtaaatactttctctcaatctgtagcttgtcttttcatcttagcagagtctttcactgaacaaacatttttaattgtgataaagcctaataagtgttaagttttccttttatggattgtgcttttagcgtcaggtctaagaattttacctgtagatcccaaagattttctcttgtgttttctcttaaaagatctgtagttttatgttttgcatgtaagttcatgatgacatgtttttaaaagcctgaaatagggaagaaacttgaagcttgtggttccacaaaagaaacagcaagaattgcttctcataggaccccagcatggacaaggcacgggttgagatggttctggggtacagagaaggggtgctgcagacagtgccactttggtgttgtaacaaatcatttttggggtgggtgaggaagggctgcgttaaagggccaactcctcaatcccacccatacccatccttaaccctcccggagcactgtcaggtcatatgctgaaggcttgagaaattgcgtggtaagagatattgtaaatcgtatgattgggagatcaaagtctttcagttggggcaggaagcaggcctggttttatttttaaaggcacatcagtggtatccctccccagaggaggagaggatcttgtcttagaggctgcagccaagtgctgaaacagcttcctcctttgcctggaactgcagagctgtcaggaagctggcatgtgaatctcagggaatgtgccagtggccagtagaggtgaggggcccatgtgtaacctcagagggagctttagcgctgcagcacccacagtcccctctctgtcttcatagccgcaggctgtctggtctggcttactgtgccactgtcactccagagagcggcacagcctggagtcagaggatacctatgcttgcatcttggttagctgggtgacttcataccagggtcttaacctctctgattctggagtaggtggtggcttctctggcgtggtggtaagcaatgagcgaacaagtttcttttgttccctggagagtgctcagttctgtgcctttatacttactgcctgaggaaataagagccactctcacccacctgtttaggatggggacatggccgctgaccactccagtcatcctaaatataaatagaggtggtctggctgggccctctggcaatgctgtgttgacatgctgtgggctgagggcctggaagcctacgtgtgggtgtgggcccctggcaggactggggatgaacagtggcttgcgacaggacattccccttcttgttccctctgtatctgcagagtcaggtcctgcctctgctccagtcacatggtgtggccccagtgtagggttatccctgtccctggtggatgccgagaagaggtgggaggtatggggtgctatcaagagaagctgtcttcctcaggtttcttctgcccgcttccctggtgaggcagttccacatcctgactaggagtgtgggatatggattcctgttccgggctccagtcccaactgcactgcttactgctgtgtaaccttcagcaagtgagttgacctttccgtgccttagcatccccatctgtaaaatggggacggtaatagtggccgcctctggggttgtcatgaagattaaatgagggaagatgttaagagcgaagccagcgcctagctactggtaagcactaacaaaatgttagatttgttcccactgttcctgccattatggctactcctgccaccccttctactggaaagaaaatgcagtgtgactcctccatagctaagcatcaagggcaagctccctggacatccatggccctgtgcagcattggaaccacttcctggaggccgcagaagcaccagggctccattccagactccggctacaaaggccctttgaagtttgcaccacctggagcaggcttttgtgccatgagagtgtcgggggcagggggttcaggaggaggttctgtgtggaaaaccctcctttgtgcctggtggactggtggtggaatgctcaggccaccctgggctgtaccaaccctacacagctctccaccacacttcttagtctgctctgcacttaaggattaggtcccaaagttcattgtctacgttttcattaactgctttgtaaatataaatttaatgtcacataattgacaggcagtatgcaaaatggggtggggattccattatcatcgtactgtgagaacaacatcctgtattccctatctttttttctacgtgtatcttctagagagggacagtcatgtgaattggtgggctgtgtgccctgcttttggtttagcatggtggcatggacagtctccaggtgtgtgagtgctgcagaccgctttgcccaaggctgagatggaagggtggctgtgagaaggaggttcattctgctccctttgggaatttggcgtgaggtcagcatgtttctcaacagtggttccattttttcaggtcctagttggtgaggtcagaggaacagaaaccacaatagctcatgtcagagctcattggtcttggactcctgggtgaccccctcccccagttgctgaccagtccctgtggaacttgggcagaggaggtccttgctgtgtgaagtgcagtatctccatcatttcacacccctgggctcgggacttcccacctcaccctagttggcggagccttctttggaagaaaaccatgcatggcagcctcctgataccctccaacgtgggtagtgcggacgcttcttggttaaaatttctggggttagtccctggccttaagggacactctcatcacctcattcttgatcgttgccatctcaccttttctgcttttcttgtccagaaacagttgctcagcccctggagtctggttgaatccatgtctctcattctgtgtcctggttttcttacctccttccctcaaggggcagagctgaacaggcagggacacatgtgccctgacaattgtaatgaagtatgtttagccttcttctcaaagggaaatcagaggggttcagttcagctgtgccgtacccgggatccacggttgtgccgggcttgctggctccacatgacacagcttgatagcccggtgctctgccaactttcagggtggggcctgtgctctacgagggctgagagcttgtggcggggtctcggtgtggtggagggaacaccatcagtgtgctggggtgtggggtagcaggtcaccagggaaaggaaaacaaagggggaagaaaatagggatgtattgatacatttgggggaaaacacagccctgagagagaagcaagtgtctatgttggccctgagcaaaagcgataaatacgtttggctcttctgacccagaggtgggcatatgtggctgggaattctggtggaagtggctcattgtccatctctggcccaacttgagcctggtttttcatctcttagcccaacctggtactgctttgccatgcccagatgccaagacagctgacctccgtgtggacatggaactaactcctcaagccccttagaagtcactgcccatgttaggatggcatagcctttctccctgggaatgtgatccatatgtggcttgtacagcttcctcgggtcagcagtgtccacgtggaactcccaggggaggcgtgtggatggggacctcaggcagggccgagctgtggctagaagtgagtgagggagagattgttggccagccttggataagcataattgtctcaacattgcaagccagtgagggccagtgtttggggttcaattgaatgtgggaaatgcgtaagtaacccccaccccgtgctatttgaaaatcgaaaatccatcgtattcgacatttgcttttaaataggtctgtcagcttccctaccttttttaaaaaagttaactccacgttgtgtcttaaatttttttctttttaaaagtttttaattggatggttggtcctgcctcagtgttttttttttgttgttgttgttgttgttttgttttgtttttcctgagtaatgttccttggttcaggtttgttgtggtgaatgtaagacattgaactaaagttgtaatttgtttgtttattcaacaaatattgattgagtaccttttaagttctaagcgttattctgggggctaaggctatagcagtcaatacgatagactaaaaattcctagccggtgtgcggtttatattctacccagtcgagactgcaggactacttaatactttaggaggttttgttttgttttgtttttaattaatggacttttatagcagttgtaagtttacagaaatggagtggaaagtacggagagttcccatatgcccccgccatctcttctctctccccctcacacacacacacacacacacacccaccctgtttcccctattgttaacatcttgcattagtgtggtacatttgttacaactgatgagtcaatatcgatccattattactaaagtttatagtttacattagagttcagtcttggttctgacaaatgtataatcacatgtgcccaccattacagtgtcatacagaatagcttcactgacctaaaaatctcctgtgctgaacctgctcatctctctctacccagcctctggcagttaaatattgttactgtctccatagttttgcctttctcagaatgtcatacatttggaatcatacaattggtagtcttttcagatgggcatcttttactcaacaatgtgtatttccttaggagttttgctgctgctcttgtttatttgtgcatcttaaatgcagaacattctgatagtttggattgggtcctgggtcattcatgagttgggtcactctagacttcacagaacagtggtggccagctgttgatcgtacctagattttttcgtttcagggatccggggctttcagttcaatgggtgtaagttgatgggtgggagaaccaaatgggatctgctgtagcaaggtccctggggttaggtagtctcatggggatgggacattgggtcgtctttgcaaggagttaatggaagctgtttgttgaagacccaaaggggagggtgaccctaaaggaagtgaacgggttgggaggttggttgacacagcccagtcctgcctttggagaggttgaccctgcctggcggaggctgtttatcccgccactgggctgctcttgttttttatccagtctccacctgaataaacagatctggaacgtcatctgcagccaggctgagaatctgccaaaattccccagggaactggtgattcaccagcagcaggggaagagagagggaacaagcaagagagagagacctgcttattctgattctcatttcctgtccagcaaataacccaggctgggctgtttcttacgagacagcagttctttgagtaaatgatcaatttctgcaatagaacaaatgattttgattttaatttttaagaagatggatgtaaagcaggctagagggaaatggtttcaactgtcattctgagaagggagacttttattcaagttggattaggaaagctcttccgcattcacttgttcttgaaaaatgtctcatcttaattttcaagttctgtatgggcattggtcctggcacaagtgcattatcgtaagctgtggactttagcatcaacattatttcttgccaattttgagacttagaattattcttttttttttgtgatcattaggccctcacttattttaaaaaattctactggacacctgaagaagattagattgagcttggccatgttcggtggccccaggctatattcctaatgtgttttttggggaggggtcagaaaggggacatatgagggcagtggcatctgagaatgtggtcaaatgaagcagcatgaaacagggcacttggagctaatggttttcagattcatttcaaccctgggggacttgatttaaaagaaaactaccagtgtctgctaaggccagacatatgcaagctcaatgacctgagtagcaattccatgcctggacattgcacgcctgccaaaaatgcatgcagacatgcaccagaaagcaagtgcagaagacaagtccgtgttcatagctgtgatttttgcaatagcctgaattggaaataactcaatgtccgtcaacaatagaaagaaaaaataaattgctgtatgttctgtcaatagaaatatcgtacagtgatagaaaagaattaactactgctaatgcagcaacccagatggatctcataaacaatgttgagtggaagtagccaaataaaaaagggtatgtacagaacagttttgtgtctgtacagcacagaaataggcagaattaattgtgggtggtagaaattagaggtttcctttgggaggaataacaaccaggagacaggaggagggaggcttctgggtgcggaaatttttctctacattttgtaaaaatcctttatatttcaataaaaatgtttacaaacaaaacaactgccagcatttggccatatggcctgtctgatagtgctgcaattttaaaaaaaatttttttaagagatgagggtctcactgtgttgcccaggctggtctcgaactcctggccgcaagcagtccttctactgttggctcccaaagtgttgggattacaggccagagtcactgtgcccagcctgtgtcttctgacaaggagaaatcatcaccttcatgtgtgtttttgaaatggttaatgttttttggcatttgcagtcataaagtacacctccttaggtaggcatcagggctggtgtgccctgtactaagtttcatcttccgtcagtaatatgagggtctcagatagtctcacattgtgtggattccaggtgtgatatgttgttaagatacactgtagcctcagaaggcatatgtgaatgtgtgcacgccttcattcattttgattattttgagtgcgtgctgtatgtgggtggtgacagtgagtgtgtgatgcagagccttggtaagaattccagtgcagcaccatgatgggcagagtgctgcagggtgtggagtttgatgaaacctgtctgccaggatcactttgttggggtaatgggggccgggggtgttagattttttttccccccagtctagggctagattatgtgaaacttattttctaaccggaggttcaggcgaagcaaagagctattatgtggatttcgcttattcattaagtaagacgtgttaagatttgatcttgaagtaaaactgtggtagatttgccatttcggtgagagtccacactcagatagttgactgtggactttgtgaatcactgtaattgtctggaagggcggaagggcacagcttcttagatcttagggatggagagctggccagcttcagtatgtttcagactaattggcggaactgaaacgaggaaggatataggatatacagtgtggatttctgtcttctgtaaagtaaccctgtttgcccatctatcttcactggctccagtaaggaacctggttgatctcttgaggaacataacagtggtagagagacttatgttccatttcactttctgaagaggtagaaaagacattggcagaaaagactgtgattagtgatgtctgacatgggcactggagggacaatgggaaagttttctctctgcagttaagaggtatttccttattttgcaggtggttaaacgaggtagagaaagagtgatttatacatggttccaaaattgcatgacagcaagaattagagtctgggtctctgcaccccaagaaacacaaactggttgccatagggttgacagggtcagcacaccacagacagtggtcccaatcctggcccactgcttgtttttgtaaataaagttttattggaacatagccacactcattcatttacatattgtctggctgcttttacattataacagcagaactgagtggtcatgacagagacagtatgacccacaaagcctaaaaatttaccatctggcccaatgtagaataagtttgctggcccctggtgtagaaaataggtgcataatttcaggggtcagaaattacccacttgacccaccttgtcccaactgcctttgatctccttgccctttcttcctggctgttatctgtgacatgagatcttttccaccactaacgggaataccttgtaaaccaggctttcacagaactgtagtggaacaatcacttatgagaaaaagttttaaatgttggtttcaaatgcctccatctgtttcactgtctaatttaacatcagctctgaaaatgtagccaactggggagagcttatcttgcctgctttccgcctttgaagactgattttatttttgaagcctttaacaggtgttggtttaatagacttctgctgtattaagttctcctcgctccagagggcagcccaaggggtaaactgacactgtggatggaggcgaatgccacgtgacctggccaccacacacttcccccggtccccataagtgcagaatcactggttttgtctggttgcagagaaaggctgcgctgttcctttgatgaggccaataagaactgttcctagcacaacactgtcctcttgccttgcaccatcctcacccttttttgtaaacttaagtggatccctttgcagcttaccttccctaacaataaagatactccttcctccctcgatggcagatctttcaagatctcaaagaaactgcccttttctttccatccagaacattcaaagtaaaaacttgagctttatctgccttatttgctgagattctgtcacatgaagtcctgtgcacatttgcttctcacacaggactctgggaagcttgtatgagagctgggccacctggccgaggccaagctacgtagaacaggctgagttgactgagaaatggccagctaatgttcagatttagccaagctttggaagtttatgggtggaatctgggccagtgcccttaaagttctgccaggagagcctctcggacgggctagatagggtcatgcttccctgggcttgcatcccggctcctcttgcttcccagctgtgtgaccttgggcaagctccagcagacttctgagcctcaatttcttcaattgcctaagtatagatgcttctcaactgacaatggagttatgtccagataaacccatcctaagttgaaaatatcattaagcaaaaaatgcatttaatacctctaacctcctgaataccacaacctagcctagtctaccttaaatgtgctcagaacactcatattagtccacagttgggcagaatcatctaacacaaagcccattttataataaagttttgaatatctcctataatttattgaacactgagtggaaaacagaatggttttatgggtacttgaagtacaatttctattgaatgtgtatagcttttgcaccattgtgaagtccagaaatcgttaagctgaaccatcgtaagtcaggggctgcctataaagataatagtacctaccttgttagattgctgtgtgatggcattgatgctttgcccaggatctactgtgtatataataggtgttcattaattggtcagctgttgagaggcaataaaaagaggtatggatcttcttgggaactgtgcagttagttatgttaaaggagtgaaaatgatgaccacttgggtttgcatgtggaattgaaaacatggatagtttcctgaaggtggaatgccgggttgagcgagggcagcagacacgtttccatggcatcaactctcaggcaggaggtgggaaggcttccctgcaggggtttgaatgccagctgtttactctaaccttcatgggggggagacctagagagggtatcttagaccagcaggctacctctggaatggtggggttggtggggtttggtgggcttgggtcagggacgtggcctcagttccacttgctgtgggagtgggggtggggggtgtcatccagatgctggggaatctgtcagatgtctagccaccctgaatcctgcagaagttgcagtctgggatttgctttgaaacgtggggtcttcccagtggctgggtttgacactctccagctggagcaggcttcttttatgcttgaagttaagagtgagagctctgagtcagcccttcgttcctgagaggggagccagagctgcttgtttgcactgaaatatgtcagaagagtagacaagaaccagtcattaattttattcttttttccagagcacctcctacagactagatccttagcctggctctgatgacacaagcatgactactaaaaacaagaactcattttattgagcagttgttacgtgtcaggtcatatcagcccatggggcatatgaacttcacacatcactttacagaggggctcttctgaggttcacacctgtgagtgggatagctgggatttgaacctgggcaggaagacactcaaggcatattgttccacagtgctgtgccatgttccacagcaggaagaactccacatgtgccttggagaccatggacaggacttacttgggagacacaagaatcatcatttgagatttagacagaggagtgctgtgaactgagtcacattttgttttaatttgtttcttttgagatggagttttgctcttgttgcccaggctggagtgcggtggcgtgatcttggctcactacaacctctgcctcccaggttcaagcaattctcctgcctcagcctcccgagtagctgggattacaggcatgcgccaccatgcccggctaattttttatttttagtagagacagggttgctccatgttggtcaggctggtctcaaaactcctgacctaaggtgatccgcccacctcagcctcctaaagtgctgggattacaggcgtgagccaccgtgcctggccttgttttaattttaaattgtggtaaagtacacataacataaaatttaccatctgaagtattttttaaaatgtggagttcaatggtgttaaatgcatttatgttgtgcaaccagtctccagaacttttttccatcttgcaaaactaaaacttcatacctatttgatatggtttggctgggatgatgtctacccagatctcatcttgaattgtaactcctacaattcccatgtgtcatgggagggacccagtggcaggtgattgaattatgagggtgggtccttcctgtgctgttctcataatagtgaatgagtctcacaagatctgatggttttaaaaactggagtttccctgcacaaactctctttttgcctgctgccatccatgtaagatgtgatttgttcctcctcgccttctgccatgattgtgaggcctctccagccaggtggaactgtgtgtccaattaaatctctttcttttgtaaattgcccagtctttgtgtctttatcagcagcgtgaaaaataactaagacagtaaattggtaccagtagagtgggacattgctgaaaacatacctgaaaatgtggaagtgactttggaactggataacaggcagaggttggagcactttggagggctcagaaggcaggaagatgtgggaaagtttggaacttcctagagacttgttgaatggctttgacaagaatgctgatagtgacatgaacaataatgtccaggctgaggtggtctcagatggaaatgaggaattgttgggaactagagcaaaggtgactcttgttatgctttagcaaagagactggcagcattttgcccctgccctagagatttgtggaactttgaacttgagagagatgatttagggtatctgatggaataaatttctaagcagtaaagcattaaagatgtgacttgggtgctgttaaaggcattcagtttcaaaagggaaacagaacataaaagtttggaaaatttgcagcctgacaatgcaatagaaaagaaaatcccattttctgaggagaaattcaagctggctgcaggaatttgcataagtaatgaggagctgaatgttaatcaccaagacaatggggaatatgtctccagggcatgtcagagatgtttgcggcagcccctcccatcacaggcctggaggcctaggaggaaaaagtggtttcgtggggcaggctcagggtccctgtgctgtgtgcagcctagagacatggtgtcctgtgttccagctgctccagctgtagctgaaaggggcaacatagagcacggaccatggcttcaaagggtggaagccccaagtcttggcagcttccatgtggtgctgagcctgcaggtatgcagaagtcaacagttgaggtttgggaacctctgcctagatttcagagcatgtatggaaatgcctggatgcccaggtagaagtttgctgcaggggcggggccctcatgaagaacctctgctagggcagtgtggaagggaaatatggtgtggccctcatgaagaatgtctgctagggcagtgtgggatcccccacacagagtccctactgcggcactgcctagggaagctgtgagaagagggccactgtcctctagaccccagaatggtagatccactgacagcttgcaccgggcacctggaaaagccgcagacactcaacgccagcctgtgaaagcagctgggagggaggctataccctgcaaagccataggggtggagctttcccaagaccatgggaacccacgtcttgcatcagcgtgatctggatgtgagacatgactgccccgctggattttggacttgcatggagcctgtagcccctttgttttggtcaatttctcccagttggaatggctatatttacccaatactgatacccctattgtatctatgaagtaactagcttgcttttgattttacaggttcataggcagagggacttgcattgtctcagaagagactttggactgtggacttttgagttaatgctgaaatgagttaagactttgggggactgttgggaaggcatgattggttttgaaatgtgaggatgtgagatttgggaggggccaggggcagaatgatatggtttggctgtgtccccacccaaatctcatcttgaattgactcccacaattcctatgtgtcataggagggtcccagtgggaggtgattgagttatgggggcaggtttttcctatgctgttctcatgatagtgaatgagtctcataagacctgatggttttaaaaacaggagtttccctgcacaagcccttttttttgcctgctgccatccatgtaagacatacttgctcttctttgccttctgccatgattgtgaggcctccccagccacgtggaactgtgagtccaattaaacctctttctttcataaattgcccagtctcaggtatgtctttatcagcagcatgaaaatggactaatacaccgttaaacaacagatcttccttctgcggtctccccggtccctggacaccaccattctactttctgtttcagtggatctgactactctagctacctcacataagtggaccatacagcatttgtctttttgtgacaggcatctttcacttggcatcatgtccgcaatgctcatccattcagtagcacgtgttagaatttcttttctttttaaggctgagtaatatctcattgcatgtatatacaacattgatggacatttgggctgttccacctttggctgtggtgagtgatgcttctatgaatgtgaggatacacatgtctctttgaggtctgctttcagttatttagatatgcagaagtggaattgtgggatcatatggtgtgcctctgtttaattttttgaggaatctccataatgtcttcttctgcaggtgcaccaccgttttacatttctaccactggcatacagggtttcactctctccacatcctcacccacacttgttattttctgtttgtttttttgttttgttttgttttaatagtggccatcctagtgggtgtgaggtgacttctcattgtggttgtggtttacatttccctaatgaatggtgatgttgatcatcttctcatgtgcttcttggccatttgtgtgttttctttggaacaatgttcaattcttggctcattttaaaaatcaggttggttgttttttgttgttgttgtagaggttctttatatctggatattagccccttatcagaaatgtgatttgcatatattttctcttattccgtgggatgcctgaagtgacttatttttagcgggtctctctggctgctgggttgggaatagactgtaagtgggcaaggatggaagggaaggtctagtcagtagcccatgggcatggttatcttccatttccaagctagaacattttgaatcattattgatgcccctagttgtcatctccagcccccaccagggcagggtgtttcaaggtaggatgctgaagttgggaggagacaggtggggagaggccagcagctttgatcagagggtggagctggtagggtgggtaggacctaatcagagggtctcttgtgcctgtctctgtattgccgccatctctctcctggcccactgtggcatccattcccaacttgttagcttgggctgcgaggcatttgctgttgtggtcctgcccaccctactagctctgcaatctgatccaagctcctggcttctgcctacctgtctcctcctggcctcagcatcctaccctcagacattcgccctggcaccttgtgcactcccttgctcctctcacagaccctgccactgtggccctcactcccacacacccttgtctcccatctccacggctgcctcttctgccaaatggggaactttcccagcgggtgaaagagacttgtcttctgcacagggtcctttatgcagagtggggcccggattgtgtttgattcagcgaatgaaaagactgacaaggagcaaaaggtaccggaccacagacaaagactgaggagacagaggaggaggtggggagaggacagaactggcgtgggagagatgttgggcctgcagctgtcccacggcttcgcaatgtaaggcctcaccccctctttgtgcctttctgggccggtggcgcccggcccttctgtccagcacagacccttttcctggcgccctgataccacattcacagttcccggataagactcagctctgtcgcctttatttcttgtttcttttcttcccatactttacataataaaggttttcttttcttttttcctttggagccagaaaactgaggagactatctttattaaagaacttaataaagaactcaaaggaagtggctttgggggctggggaggagaggaagggaaagggtcctttcatgccggggaggttctgtgtgcagagttgcacccttggaaatggactttcgagttcagggcctgggagacgcatgaaaaaaacaaaggagtccacgagaagccccagagcttctgggaaagaggtccttgtttatgcctgttggaactgattcggtcaagtgtttgtttaaaggagatgccacttggtaagcgacgcctggcttacttgtgttgtgttcaagaatgctttgattggccagagatgctgacactgtttattcagaactggctcgagtgccagtgcctgcaacctagaggcccagcgccaccacccagcagattcctaagtgtctaatattggagtgagggctgcagtggtttgactctgccaggcggcgccaaacccacaacagggcggttagctacctctagccttggctagcattcgtctttctcttgacttataactgttgcttgtttatatagtgggtttgacagaaagtagattaaaggtgcgcacaggccagctgtggtggctcacgcctgtaatcccaacattttgggaggccaaggcgggtggatcatgaggtcaggagatcgagaccatcctggccaacacggtgaaaccttgtctctactaaaaaaaattaaaaaattagctgggtgtggtggcacgtgcctgtaatcccagcgatctgggaggctgaggcagaagaatcgcttgaacccaggaggcggaggttgcagtgagccaagatggcgccactgcactccagcctggcgacagagcgagactctgtctcaaaaacaaaaacaaaaacaaaacaaaaaaaaaacacaagttacagtggaacattcctgtcttgggaggtggtgaccactaaacatttaccttcagatttgccacatgctttatgtggttttaggctggatcgtccctatccctgaagtgatgggttgtggccccatcttccaaatgagaaaaccgaggcacaatgcttaatattaatggtagagtcgggaggttcagggaactcaatttcagttagactcagcagtgagctcctctttcccattttacattgtcaggattttgtcgtaatctttttttttttttctttttctttttgtttaaatcctctgtgtctggtatatggtaggtgttggtaaaatgtgaggtgtgtaatgatgtgttaaactggattaaagtgaactctgggctgtggtgcctatggctcttgtaagttatgaggctggactaggtctgaggatgatgggtgagagttggactggagctgtctggctgcacaggacagggcacatcctttatggtgagtgcatccgtggattctggtcaggtcatgctggtctcacatggtcttcagtgtcactgctgtgttgttgcccttggagagggaagcctagggatagaactttgataaacttgtcccagattgaaaatccaatattctcctagcatctggccagcaggtaataacttgatgggaaaagaaacaggagatctcatttttaagagcgtcactgcattgtagttatattggtggggggtggggtgcaggaatactagtttcttgtagttactttgcaaaaagagatgctcaagtcacctcccttgttgtgtttcaggcagcacaacaagattcgcagcgtggaggggagccagctgaaggcctacctttccttagaagtgttagatctgagtttgaacaacatcacggaagtgcggaacacctgctttccacacggaccgcctataaaggagctgtaagtgcctctgttctgccacctgtggctggcccgctgtgtccagccagctaacagcttcaccggcacccagttctggatgcaggagggatgcttccttcccttctcaaccacggctgggccgagtcagtggggatggttcagaccttccctgagcagggcaggggcgagccccatgcatagagcacgtccagatcctgcagcattatcctgacattacagacagacaagggacagaggcaggaaggactcagcactccaagacgagagtctaggactcaagaacagatcgatcttgaccacaaagcctgctttttttcccatttccttggctgcctctcagaaatgcttccagaggagattcagggaggatggttagaggattcacattggaagcctgtctaacagggcttagcttatcagtgcttatctttctagtgtcatgcactgtaaaacaagtcattgggtttgtttgggggagggcagttactctattatgtgggttttcagcaccttttagatttgtctgtttctcttacccatattaatgtcccatctcacacacaatggatggtagacaggaaggaaaaaaagttaaaacctacttaatcaactacttgttggtaggaaaagtgttactctgggaaagaaactgcaaccccaggctaaagagacgttttccaattccaggtgagttttcattccgtgtgtcattactgttccagagttaactttggaacgcattcgcaaggctggtttaggggtcattgtgacccatcttttcagggagggtgaggtttggcacatggattttccaagtaaatactgcaagaagaagagtgatttctttcttagcctgcattagggcgccagagttgggaacaggaggccttggcttttgtgaagcctccagtgtgggccctcaaaaggtgtccacgtgacaccactttgcttgggacagagaaaccataactgctacactaagttgctctgacctctccctgcacaaaagtgggagggactttctattttggcagctattgggtgatatatcttcatcacacaggctgttctttaatctgaggtgttgagaacaaacagtccagccccatttgcaaagaatccttatgtgccttgtcctaggccactatctgctggagagacaaaaagtgccttgctcccttccaccctctgtggcagaaaatcctctctggtctttctccttttcacttaggccagaaaaagcagcatttgtttggggaaggcagaggagaggtgttggaaaccacttctcacaggaatgccatattgttcttccttgtactttcttttcttttttattacttgatataatttgcatacagcaagatgcacagatctgagctgcagacttctgtgccttttgagaagcggtgtctgcctttttgtattgtcacgggagatgccccgacttaatcacgctgtaagtgtaggtaccatgacatattgcttgttttacgaagggattctgcacaggtctcttcagctagagtgtttctttgaggcatttacaattacagaaatgaattggtttatacatatgtgttatgtagttcatatagcaagacccacctcaaaactaaaggctatttctctaaattattaaattaacactgaccttgcctttcagttgattttctgctttctaggagttttcacgtcaaccttgggcactgggtggtgagaagagtcctgcaggtggctcctgacgcagggctggtgtgtcagtgggcatgggggtgtttgactttcactcccaccctcttggggtggcccagcagcttcaaggacagtatgctttcgactaaatcggccttgccctcagggcttaggtgcacagtcctaacacctgcatctctctagctccccatccaaagcctgtggctgataaacatctcactggaaacctgtccctctggtgtcttaactcatcttcccaactcagacccagagaggtctggtgtctataatgaaatgaggaaggcctttgaccaaccaccacattttcttttctgaatcattccagcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactgtgagtacagaaacctacactttaattaaggctagccaaactttatggaggccagatttccccaaggacctcgtaccaaacgccaccctttccttgctccatttggtaaagctctccataaattaccattaatggcagcacctcataaaagcaaattcggagctgggtctggtgctgtggctgcttcaggttgctgagaaagacatccactgaggtcgcttttcttccctgatgttttccaaaatggaatcaggagtcctgctgcttagctgatgctggctaatgctgaggctgcatgggtttgggttcttatttatcttagatgtttttctgtatttttttaagatacccgtaaaatctgtaccttggacatggtggtgtccgacacttcttgaacagtttgagaggaagttagtgtagctggagttagtaagcaaaagacaagcctttgtcttcatatctttaatcttacaaggtagttgatttattattattattatttatttatttattattatttttttttgcgacagtctcgctctgtcccccaggtggggtgcagtggtgtgatctcagctcactgcaagctccgcccccggggttcacaccattctcctgcctcagcctccagagcagctgggactacaggcacccaccaccatgcctggctaattttttgtatttttagtagagatggggtttcaccttgttacccaggatggtctcgatctcctgacctcgtgatccgcctgccttggcctcccaaagtgctgggattacaggcatgagccaccgcacccggccgatttattatttttgtaaacaatttaattgtttagtttactgatggaaggctgagtacccttctagaaggcagagttttagattcaagtaaagctctgttaaccagagcctgacgaaggactttttttccctgatttttttttttcctgtgccctctttttagcagaagaatgtatttcaggaaaataagacagtattggaaattttgtttcaacaaaacaaaataattgtcgagggccaggttggcggcacgacggggtgtgcctggctctcatcctacctgggtttcacctcccctgggtggggagtcctagactttgccattttcagtctgtggagaaggtctcagtgattcctgagaaggtttgtgtggggcagcatcatgagacactgcagaaatatttggggaaaaccaagggctttctggctgctctgcctccccttcccgcaggggtgctaatggatctggcccacccagattcctgacatcttttggtgaactgaggctttgtcatactggggctagaagccaagtgtatatgacttgtggggtgtctctaccccatctccccctgcccccatgtgcagtaacttctctccatagtggagatgctgtgaaatgcccccagtggaaagtgttattgccatttgatacatagtggtttggtttttcctgggttgaggcatgtggtgtggatttctgttgctgagctcagagatacctcacataagacattcaccccttgagtcatacccacgtcctcactgcagagtcacaaatggcactggtgctactgggggaggagacgtgagcacacacgcgttctcttctgtgcagctgtgggccagcctcggagctggctgtggagagctggcctcactcacccctcttgcctgcactaggtgtggtcaggtggcagcatcagtgcctgcatggcagccgagacacatggtgggctcccctacacatcctggcttcccagggatccctgcactgggatttctcctctggcttggaaacttagccaggactgcttcagaatggttgtgggtgggatatgcacataagacactctgaccctgctggcttcatctctttagggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgtaagtgcggaccaggttactggcattgctaaggattgctgtgcggtgtggtgtgatgtggcgtgtgtgtgtgtgcgcatgcatgtgcgcaccaacaccaacgttgctgtgtgttgggtgtgtgcgcccacaccagcattgctgtgtggtgtggggtgtgtgtgcgtgcgcgtgtgcacgtgcgcgcccacaccagcattcagctgtgcactgggcatggagtggggcaccagtgcccagcccctctctcctgaaggattcttcaagacttcagccggacccagcccccttccctttgcagcttcacctgggcccaactcattgtcttggggaccgggccaaacctgagggtattttcctagcagattgggacatccactgaaatccacttgggggaagtttcagcggattgagtcagataagttggttgatggagatggagtttgggggccattctgccaggactgctttccacagcttgcatccactgcccccgcccctgcttcttcggtgaacgtggggctgcggaacagacccctcctcacatcctctccactcctgaccacaggaagttccttctctccccttctgggtttgacagtctttcctgaggtgcaggtgggccaaaaatgtagagctcatcttaggaggtttatttctgtcttgtgagctaatcaagacactgggtgcagatgtttaagttttatcaagggagcagtctcttcagccagatgtgtacagcagcagaaggggcttgcctgcacggtaacgtgaaacagcagggcagcatacagaaaaggctttttaaacgttgaaagcctttttaaacgttaatatttatttttaatcaaaagtaatttgactgtatagttaaataaaatcagatagtaaagaaaagccatcactgcccaccccagcctcccccgccaccaccccctcattctctcttcaccccagttcttctcccaagaggcaagcacttctaagcctttctctttttcgtttttctgtttttagctttgctggttgttccttccaagttgatagactgacaccactgtctttacttatccacttgcgatttcctccttgagagtcaatgatttaacttgctcatgtccgccccttcttcttccagtctgggcaaattatatcatgactcgaatgtcctttactggttttcttggcagtggaaacgagctaggcccaggtccatccacatgttgtgctgtgtcactctgataaccgtctctgcatgaccagccctccctactctgtgaacagtgaggatgtttcctgccgctgggcttcttgctctacccattctccaccctttgttttacatattcaaaaacgtttcacttgacctccttaggcatgtcattttggacttggaagtccaaggtggtcatgtgctgggtggactgaagttaaaagagaattctcagaggaaaatggagttagcacctaccatttggtttttatgttgaacagatttgtataaattgagactgatgagctgccttagaggttatttatacattaagtgcttaccttttgagcagtagcagaaagaaagatggaaaaaagcaaaactcagttacccaaagcccttgtaatactgaacacggagcaaaattcgggttacggacttttgttgaagaggcggttgcctgggctggcgctgtccttcctggcacatgctgtgttgggaagcggggtgctagcacacttacacggtgggcctgagagctcaggcctagagctgcactgaatcctgatgtacccttgtttccttcttatagtgaccccatggagtcagtgctcttggatatctccatgttagtagatgtgcaggtttattcagccagcaagctgcaaaattaggatttaaatccaggtagtctgacgccagagctaaagcgggtctcctagcacagtggcacagagtccagcctttggtaggcagacccagggttgaattaattctagccccttccctactggctaagctgtgtaaagtcttagacaggttacctggcttctctcagcagcacattcctcatgtgtgagatgcgggtgataataagagccgcctcctattcgctctcctttctattcctttaatgggctttgcccttgcctggaactcctgtgcccgtttgttggcctgggtcactttttgttttgtttttggtagagatggggtttcgctatattgcccttgctggtctcgaactcccgagctcaagcgatcctccttcttcggcctccccaagtactggatgggcataagccgccacacccagccctggttcacttttactcagccaaaaaagtcacttctaggaagctccctcttgccctatgaacactcgagtcggccttggcatgtgctgtcatccattttgatttgcctgtcttctcccagcccctactcacatgcacatgtgtgcgactagactccacagttctgtcgtgcactgttctagccttggtgtgaccgcagtgtcaggtacagcgtggctgctcatttgctgtctgtccagtgaagggagtgaaagctcctcttcatcctgtgcatggctgtcattgcaggcacctggagtacaacagcctggtagaagtgaacagcggctcgctctacggcctcacggccctgcatcagctccacctcagcaacaattccatcgctcgcattcaccgcaagggctggagcttctgccagaagctgcatgagttgtaagtgtcctcggctctgggctgtggcagtgtttttagacactgcttggaggtgaaagtgctaggcctggttcgttccaccacacagtggcctcggggagggctcagagacaggccagtagccctgttcccaaaccagccaggcccagggtggaaccctcagcgatttgagccccagtcccttcctcatctccccttcacttcctctgcatttggattagcaggggctccaggagtagcagctaggtccctgcagggagccttggcccccaaggtcctgttgggtttggagacagttccaggggtagaaagttcctggggaagggcagctatggcagagtgctcacaggagccattttgagagtgactgtgtgttaatggccacaccaaatagcatgtgcttcttcagtgagggggtcatttgggctcaaacagagacagtgaaacgctgactgtggatgaatttgtgtcctcggagtcgccaccttccttcctgtagatgagctgcccaggttcttggccccttccctttctctgttttgcaccgcagtggcctgctggcagaggctcctgtgcagtcgtgtgcgtgcttagttcagagatgtgtggtgtggtcctcttgctccttttggagatttccagacaggggtcccaggttgagactgagaactgagcttgtcttgcccaaagttctgagattagtagtgacagactgtcgcctgggtagcgatgggcagtggccctggccaccccatcatgtcagggtggggttactggacagtgaacgcagcattcctaaggactcagagaacatctttacaagtctatagtttgtgttttcactgttctttccatttgatatgctccagtttagtctactgtgtttctttatttttcacaagagttgggtgggtttttttgttttgttttgtttttttcttccttttctaggcttggctgttggaaaaaattcacccactgaagtgaatgattgttaagagtgccaagcctcagtctgtcctgtctctctcttgacctcaccaggcaaactcaaggggatgcgtgaatctaatgtggattcttgcagctggtgtttgtgtctggtcttctgtgttctcctctctctccctgtccttccttccctcctcctccccccctccccccaccacacacacacacacacacacacacacacacacacacacacacacacactgacttggagtttatattttggtgactccatcattatctaatgcaaaacacagtggtcctgcctctttcctaacttttcttggattctgtgagtgttaaccctttggtttcagcttcctacgcttcagggcctgcagttgtgcattccatgtggtgctggatggctcctttcaggctctgtagtcaagctgtgaccccaccaggggactcctggttttgttggtcagggccgggaggtgtgggaagcaagagaggtcttttaagtccccgaagcctgagccagtccaattcttaaagtgaggggccatcctctgactcaccagtgtatcgtggccccagggatggcatgctgtcttctgcggggtccgggatcccctctctagctggtggaaggcatgaagccctcttccatgccctctagaaggggcagcaaagatcacagaagtgcgcttgagcagtcctagcagtttgcaccatatccaggtaacctcagaggcagatttgggattgcttcccagcatgtgtttcccacccctcctttaagctaaattctttaattgcaggtgaggatataattttgatctcctgccaggtctgtttaactgacagacaccctgacttatttgtccaggagggaaagaatgctgctcctagctgcctttaaaagctcattaatcttctctgagtttattttccatcttcctatccctgccccagccccaatttttcaacgatagatgaccaatatgtcacgtaagcaacccagaggtgcaggagtgctgggaggaagctttgattctgaggttcgggcaaagcatgtgcttttaccgcctgcagtaggggatcatgctctgaggtccacgtggatgggggcagggaggcctgagcaggagcctcctgccctgggggagttgccccactaaggcatgaggcacaggtgtggttgtcccacgcaggggctagtggtgccctctgctggcagatgcagggagtgtgactggggctccctggcttgctgcggggtcatctccagaatcccaggcttctgctatgagagaggtcttttgtagcctgaatcaggagctgccttggacagcatgaaggcgctggagcttgagagttgttgtgtgtcatgacctcgtgtgtagtcttcacagtttaacagccaccctggcccctgtgacctatgcacccattctacgagtcagactagtgtgttgggcactgatgagtttctagctgcatggccacttttacccccaggattctgtgggtgtgggtgtgtgtgtgcacgcacgcgcgtgcgtgtgcatctgtgtcatttcccactgaaacccagctgactgtggcccaatttccggtggggtggggttggggggcaaccacactagatggtgacattgctgccctccctttcctcagggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttgtacgtctcccactactgacaggataaaggggtccccagtggggagagcagaatagagcaaaccatctgctttgttgaactccatttgcgttggcttcgagtcagaattggatccaaagctggcttgctctatgtgcagagtctcaaacttttatgtaatcaactgaaaaagaactggttaagcagaaaaatctctcatttccccaggatggtgcctagagagggatggcagctcctaaaaagtagttgttctcaagcagtgatgcccacgttgtgctggacaggatgctggctcctagtgttggaaaaagcttccccacgctgagcgcctggtgcagcctccagttcggcagccgtgggtcagtctttcccatcttgagtcttcagctgcaacttccaagtcctgaatattttttctctaaaccatgggaatactgcagtgcatctctcgtctgagcatttgaacttcttcagcataacctgtaccaagatgcctcctttccaaaagcagcacttagggaatcctgtgtctctccttgtacctcgtcgggggtcagttaacaaagtggaggtgctaatgccatttcccttgaagtccctaattagatggggttggcaaaagtggctgcaggatgcttttctgaggcttgtataaaacttttccatggttggcttcatagaacttccaagcagctgtcagcataaaacccccagagaggggcatgcaggtttcagaggacagtggtggcgggttctagggtctccttctcaggcgtaatccactgcacagagagggatctgttccagtgtgacagggagggaggcctttgcacttgcacctggcagagccggctttaatgtggagccattgccagggagtgtgaaagaggccggagccaagctattcaggccaggtcagcctgtgagcccatacaaggcccaaataacaaggctgggaacattcagactgagcgggccagaaaggagagaaaaactttggcagccagggctaggagcagagagacaggcacacaaagccacagccccgggtccctggttcctggttttttcagtatgcagatgataggaaggaacccattgagaggagaagtcccttccagcagcagaatctccactatttgaccttcctgctgtgacaagaaaggtcaccgccagcatttcactcttcagtcagagctgccctctctgctggcagcattgattcctgctgcagcttctcacaggagacaagagttccttttctctccctggcctgtgtctgcaagggctcggggggaaaatttaagaaccaagaaccttgtggaaagttggagagggcaggatgggggcctggtctccaggtgtgatgtctcgcctgggcactgtgacctgctcctggaagctgggaagccattgagtcatcggccatgggatttgcattgttggaggggcctgggctgagttggcctcatccctctgatcctggcgagtgggtcacaagtctgactcagcacccagatgtcctccctggctcagagtcagcgccctgcaggccttgggaggagatgggctccgggctccagacccactggctggtacggaggcgcccacgggccggccctgtgccgggtctctttcttccatgtgctttctgcagtttctcggtcatgtccagaaaagggactctggttggtatgagagcagacgggagccttaaggaaccttttgggttgattctcagtgctggggccagatgtccgctctctcggggcagaatacagactgggctgtctgcaccacctcccttcccttgagtgtggcctccgcagacagggaggcaggtggagcccagggaagtttcttgtctaaggcatgtgtcatcttggttggaaggctgagaaacagggcttccctcccagggccacgtgtctcttcaccctacgtcccggctgtgcctccagggtgcatgcacccaggggacttcagcttccgagcagcaggctgggtgagagtttgctttcccttcacgccccgactgctcggtgagctgctttctgtcctctccccagggatctggaccataacgagatttcgggcacaatagaggacacgagcggcgccttctcagggctcgacagcctcagcaagctgtgagtatccgccgcacggagctccgccggcaaatgcgcgggacacacttgggtgggagatgtttctgtggcgccccccgcgcctctctgctctgggcccaggcggaagaggagctggcttttgtttggggcagagcttgttttgtttgtggagaagagtttgaagaagagggtgggggacaccccactccttgatggcctgggtgttgggttcttgggggctggcaacccggcgtttggcggctggtggagcttctcttgggcttcactcacaactcacatgaaaactgctgaatttgctgttgccctttgtacaaaggagtcttgccctgttactgggtttctcaaagttgtgtaaaggtcagtaaggtgtgagggcggtggggctcctgtcagtactttcgtcattaaccatcatctcaaataaccacgtcatttccaagggtcgtagtagcagctattttgaatgtatggtttggggtctttttcttttttttcctagctagctcctagattttgccagttaatctgccaagcacctgtgtgtgttgtacctaatgatctcatgagggcaggctctgttaggcaacctctttattagttgaggaaagagaagtgaggggatttcgcccaaaactacacggctggcaagtggcaggctcaggatttgcttgtttggctccaaagcccacgttcccttccccttggcccgccctgttttctctgcgtgtaaccagcactttctgcagatgccacccaaggaccgtgcaggaaggggacgagagtcattattactgtttactagcagctcggagggaagactggaggagggcaagacagagaggacggctgccgctcgattcccccagcccgtccccagtgacggggagctcagcagagtgcgagtgtcaagtaaatatttggaaagccctagtggagctcgatgatagaggagagcctgtggtagggagagtctttttatatagtagatgcttctgatttgttttgaaaagcgtggctttttgcaccttttatatacaagggtcctgcttaggaataagctctgttggctgtctgaagaaggtacttcttgagcgtcctgtactccagcagcatgtcggagatgcttatcagtgattcttctccttattgtccctaaaacaatgctgattttccccagcctttaacccatacgtgacccctttttatcccatacggggcaaacctgggaagagccagaagtaccaagtggggtggggcagaggccttcttagcaagaagagctccaggcctgggatgtggctgctgaggtgttcagcactggcgccaccactcagcataagcctccctgacctcggccataaccgattgaagggtgagggtggtgagagtgggcagcactgccaggttcctcgtggggcgtgtcagtccggaggaacctggagccgtttcctgggtgtcatggcttccaggaggctctgtctcaatacagaaggcccgtgaggtgtgcctggccctgggtcgcctgggcttccagtgctgcatgagtccgccactgccttcctgagtgcccgccctctgtgccctggtgctttctcctttgtccccctgctggactaggctcagctcttccacctgagccccaagaggtcagcccaagcccctgctttcctcactcacataatgttgtttgtagtgagctggtcctgagactcctgggaacttgttaaaatcgaagcctcaccccacccagccactgagtcagcatcttggggctggagactctgtgtatgtttgaaaaagggtgagagagaaagacatgcatccaagtggggaagctgggacaataaataaacaagaattccttaatatgattaaatatatgcaatcacttatttaagtgtgatgctatcatggttatgtggcaaaagaaaaaaatgaatcattttcttcttggataaagaaaatggtatgatgcctatgatttggattccataaactcctgctgggtttgagaacgggcagtggctagaggtagagatgaggtgagattggcacgaccggaggaggattggcactgtgtcacgggcacttggggttcaggatactactccgtctacctagcatggtatgtgcaaatttccacattgaaagggaaccggagaagtaaatgcttctcatatgatcatggtacacagggctatgtaaaaactgctgtgtttggcctatcacaggtgttgagtcgatgtttgttgaatgaagggagggacagaggaagaacccagtgcctctttggtcccctccccacccgcctactcagaacattccaggaaagttctgcgctgtggccctggctgagagaagtgaccacagacagcactgtgttgctctgtgggagtggcccagtgccggcctgttaggatccactgagaagtggggtgcgtgttagcacagagaagagccgcccctctagagcagctgatccgtcctgtggggagtgcagccagtgcctgagtcccttcatttggtgtgggtttgtttttggagagctcaaggagcttgtgttcagggtctgccctaggatgggaaggtagagacccctgccttcgctgagttactcaaggaccttgggtccttcccaccatgcaagaggtcagacctaaattaaaatgttttccaagaaagggagatgtgagtagcagagccataaacggcctctctgtgaatttggggtggatgctgacctgcccttaatttttccagcttacgcacacagctgtgttggagagttcctcacactggagcttcccagcagggtgggaatgttcctagaccccagcgcatgcctttcttcctaactggtctgggattctgctgtagacccactccagggcctgtttccaaatggttgtgcggttcccgggctggggcctgcacgatggcacagagtcagtacgcgggagggaagggagaatttctggatcccaaattacaggcagagaggagcagttagtgacctgggtatgcgacttcctgcccagtggttccagctggctccatggcattcctcggagggaggggcagagtcccacacagggcacatgggaaggggcatgtttgggggatcttgcagagctgatgtgagcgcagcctccatccctgcctatgtgggggccgggcctgcagtggaactcattgtgtgtgtgggtgggaagcgggggctagtgcacatgtcgcggctacttccaaggacatgagtacaaggacccatgtgagcattgcccccagtacctgccacttgatttggcaagcgctaaccaggcctttggagctgttggctgggttggccaggagatggatgggaggtttgacaggtgactcccgcaggtcgctttctgttccaggttggtgctggggaggtcaggccaggtgttccttctgaaagggagcccggctgtggtacagaaatagtgtcctcccagcccataatcccgcctctcctttctcctggcagcagccttttattagagccatcccagtctgctggctgcagctccccgtcccagccccatatgtctgctgggggaaggtaaggaccctgcctaatctaccaacaagatgattagcccctgcataattgagaatttgagaatttattttattgctattgtcaccgttaaaaataacagcctgccctcattgtaaaacaggtcaatgtgactaatatttaatggatgaaataaagcgcagctttttcctggatctcatttacaggagatttcactaaacagttcaatgcgtttttactgggacctggggcacacagtgcctgggcggggggatctgagtaagagtagaagttggcagtgctctctgaagcgctcggggtgcagtgccccatgagctgttacttgctggcgagttttgtggttaaagcgcctaagttagcatggccatcagcttttctgtgtgtttggtttatttgttttaaaataaaagtttcagactgaagagaggtgtggaaacgctttcagaatgcgattgttttcacattcatgcagacggcctgaaagaaagaaaacgcagagggtctctggcccgtttgccccttcaccgtccggaggcaggaaacagagctggctttgtctgagggctgagcttgcagttagtgctggggtcatcctgaatggtggcccccagggagggagtctgtttctgatgaaacggagggtcaggcagcccctgtggagtggctgccctggaagctggccacacggactggtggtgcctccctctggctctgctgtgagcctgtgtttccaggaggcagcctcctggtacctgcccaagcggttcccaggaggcctgttgcagtcaggaagaagcagcggcccgtgtggtgggcaggtcccaggctgccctgccatctttggtttgcttcagggcttatatttcctttcttttcctcctttcaggaaggggctggggcttcttgttttcccttatgggtcccagtcttaatgcaggctgaaggtggagatggcttctagtccggtctcttccccgatgctaggtgagatcctggaccaagagtccccttcccagtagggggctgggccagatgggctttctccaggggcttcctctcctgcccacctgcaccccattgccttggacagacctgttgacgctgagaatcaccaggagttggctcccagcaatcggtattcttagccagcctgttagatcctggtgtaccttaagattgacaagtccacgaagctgatggtcagcactgcctttggttgttccctggtagtctcctgtgccatcaggattagagggaatgcctttggtgggttctcatcagagaacatgataacggggaggggaaaactcgattctcttcattcccagtgtccaccctaggggcttccctgcagagagacaagcttccctttagatcacacagtgtggtggaggaggcactcatttcttccatgtgttctgcaggggcgcagactttggtttctgggagaactcttaacagttactgctaaggctgggatcagagttgcctggaggcaggaacccctttttatgagcaggcagtccaggaaggggacaggcactagcgataacgttggaggttggcccactgacatcatgtaacgtctggggtctggcttaagagccaaagcactggggcatctcctgcaggccctgaggggtccctctcgtaggcagggacacagctcaccatggctgtgtgctggctgccaggacatctcaggtgcagacagctgtggagccagcttgatggatgcctattttactgtcctcttcttgcctcttttgggaagctttattcccagaatgcacttttcagaagtgggtggcagtttgggggtttttgtttgttttttgtttgagacaacatcccgctatgttgcccaggctggagtgcagtggcgcaatcatggctcactgcagcctccacctcctgggctcaagcaatcctcccacctcagccttctaagtagctacgactactggtgcgtgtctccatgcccggataattttttagtttttgtagagacaaggttgccctatgttgtccaggtctcaaactcttgggctcaagtgatcctcctgcctcagcctcccaaagtgctgggattacaggtgtgagccaccatgcccagtcatggtcagcagttttaattccgaagatttttctttccttttttgactcagcttcctctcactgaaaccataatcagtctcatctctccatcactaaacttcaccacccaagggttggtggtccttggagagagactgggccagacaaggtgatttctgcctaacactgggaggggccttttttaggccagacggcacatgcaattccagcctatcatcactattaaattctaataaagataaaagtatttcatttcagaaaggggaaggcctgcgtgcctcaaacccgtaatctcagcgcaggtcagctttccacctgcccctcactggacagacttatcaggtagcactaccttaattgtgtgttttctttttctttttctttctctcaacccttcctgtttcgctttccttccctggccttaatttctggatgtttggaaactacaggactctgtttggaaacaagatcaagtctgtggctaagagagcattctcggggctggaaggcctggagcacctgtgagtatctcaccagccctgccctgaggcacagcctgctgaatgcggctgccggggagttctgctagcaatttaatcgcatctttgtaaactgagaaacaggctatttggaaacaccagctgcttccttctcattatgtcagcttcagctttggcctttatgttgcctatgccaggaacagttacagaacatatggccagtggatgtgctcccagttaattcagttggtatttggataaataccctcccccctcctgctgcgcagcctaacccctgcactggctccttcatggacccctggcctcattgcctcttccaccaacgcgcttcctcctggccaagcctgttgcctccattaaagcagcttaacaatgcagagtaggtgctgggctgaaccagtttggtgtggttgcttctgagaccctgggaggaagggaacagagccacccgagacagtcatgctgttgccatctggggaggatgcctcatgtatgtgattcttagtttgtttcctctttgaatcaagtttgactctaactctgttgggaaaggttttgccttgctgagcaggcctcagcccagctttgatggtgccctaaggctggcttggctcctgagtcattccatgggcttgtgttgcgatttgggaaacaacagccacttatagtagttaggacacaggtctggctagtccctgtgggtcatctgtgaaaccaggactgtcctgaaaacccctcaggtgtacctagggtttctttgcataagtaatgtatgttctgtttcaggaaccttggagggaatgcgatcagatctgtccagtttgatgcctttgtgaagatgaagaatcttaaagagctgtaagtatctggattccctgggtctgattaatggtagtggagactttcagagtaagaaacttctgcaattgcattatgctcacttgttaaaagttcacatggtacatattttggattttgtgggccacagagtctctgtcatgactacttgattgcatcattgcagcagaaagcagccatagacattacataagcaggtgggtgtggctatgtgcccataaagtcacattgacagaagcaggcagtcgggccgcaggctgaagcttgctaaccactattctaggcaatgtgaaatatactctcctctataaagtggataatcaccccttcaattatgtcagggccaagttttcatcttttgggcttgcttacgataaaggcctgtgttgagagggtctacttcagagcctggtgggctgtgagcaaggcagagctctggaggggatgggatgcttaggggtgcagtggtgtctgcccataccatttccaagctttctgggcacggttcacaggtggtggtgctgccactgtggacttggactgtgggctcttgggtgacaaggttggaaaagcttccctgtatcctactctggcaggggagctagtctgggtcctcaggtgtaacacccaagttttcctttctggttttttttttttttttttagctagacatgaatctgattctacagccagtaagttctagccatgatatcagttccctgaaggggtaacttttggttcctagaagtgctgacagaatggcagatgccacaggacagtcatctttgtgccctgacctcatccccattccccgaggccactcttgatgaaccctcagttggggcagggaggctgggactggggaaatgaggtgcattccccatagctgggaactgaagcgggccgggtgacaccagactgagtgaggagggaaggtggcctgggcacttgccctgtgatgttcagcatgctgtgagcctcaggcctgctgaatagataccgtccttgcaagggttggatcttggagcgggtgtctgtgacgggttcatggagctcagggctctgcagacagctgctccgtgcccagggccttccctcttccagcctcagcagctctgcctccatctgtcgggtgagacggaacatacagaaaggattccatggctctccttccagagcaggggaggagatgattccagaccaccgtggaagggaaggctggactcagaggtggactcgcagtaaagcaagtggaatgaaacattggttgtagaagacaagcggtggggcacaggagcattcactgtggaattctttcaccttttctgtctttgaaactttcagatatgatgtcaggactgaaaaatacctgattcaatttaaacgggaagaaggtattttgagagaaggagggaggaggataagattttccttgggaagttgggaggaactggacccttccagaagcttggacctccagcgtgcttctgcatggttctggaggctcagcctcggtctcctgcctgggtttcccatcgttgctgcatatacctcgctggagccggccctgtgcccagtcctcagatgagagaaatggttaattccacttggtcgtctttttctccatcagatcaagtcaggttgtactgtgcacttagtcatcctctgggtaaatttccacaagtgatgattagaaacacactttgagttggaatcgtgaaaatgcaccatgtgagccagcaaagccctgggatggcagcagaaggcagtagagccgatggcgctgtgctctccacgggtggaagaagggcggcaggagcctgcagagcctaggggttggaatcctcgctactgcctggccccaggccctccccatgtatcctctcagtcctaacttgctgtttaggaacatgctgtctccaccctgagtacccactgtcttcctggagtctggcctcctgtctgaggtgggtttcatggtggaagaagtaggaaatcctcaaaggcgttagccccacacgtccagggcgtgtgtaggatgaggcttagccctttctacatgtgtctgatcaaagataaatgtcaaatttgttttcccgtttgttcctgtggttcaaatggaatatgtccttgtgtcctgcacaaatgcttaacgtcgcacagggatggcccagccttctctcctaggctttcgtgaacagtgcccaggctgttctgcctgactgcacggaagtgccctcttgctggggagctggaggtgcttctgacagcggagagttctccatccaggctgagttccccccatgcctggcgcagccagccctgacccccatgcagggtgcactcctgggagctgccctccccaaacactgcatgggaattgaccatttcctcagggatggccgttacagcccttccgccacctgcagtgactccacagtaggacagccctccagatggctctcagcagaacgctacctgcccgtgaaataaaaatgcaaactctcatgctgattttaagatctaatatgggccagcatcccagttataatggccttgagataagttatttctgtttttggaaaagcactttccaaaattataattattttaataagatgcccaactcatctaggggtgatggggaacatgaggaagagtggattttacttaatttagccttgggtcatctgcttacacttcattcttccttgctgtgacagtttctctgctcattagaaatctggagagaaacagaagaaaatggaaggccagtccatttggttgctttgttgatgtctgaggacagtggtgggtggagaaggcagccaaagtcgtgctcttggcctgcatgatgtttttggaatttctgcgcatacctgtgcctcctgtttgtcaccatgtaccagagacagtgtattgcagggaagcctgtgtgctctctttcccagtcttcccttatcgtgggccagccatcattctttagctcacagctctgaggtcttccaggaacaaggcagctagactcttggttgacttatcttcaagtgactcctcaggaaggaatgtccgctgagatggcgattccgatttctgtttaaaaagcttatccttagttgctgagaaatgaaaaagaaaatattctctgttttggttggagccccacaaagctaaagttgtgcattctcatgctccctgggcagtggcaattaactaacaagcactatttagggagcagagccgaattctgccggccccctgaagaatactggtgcaaagatcaaggcacaaacaagagggtggcacagtgacggggcttattacatttggaagtaagaaaacatgcagctttgccaaatggaaaaggaacagccatgaggcaaaagagccctcctcggaacttgttgcagaatttggatcaaagtctcaggccgagtttggaagctccaagtagtttatcaggaaagtgggaaaaaccagaggggggatggtggcagcatagcactgttggatgtatcagaggtcaggagaggtcagaaggcagcccagggtcacacaggaacagtgtctgtcccagaacatggcatggataagctccacgttgctgctgctccagttgcggtccttgggtcagcagccccagcatgatacgtgaacttgttagcagagtcgtgggttccactcctgacccacccaatcagcaactgcattttttcaaaatctccaggtgggttatatgcactgccctgggaaattggagaggaagtgtgagaaaaaccatttcccccttccagcttgctgatgttcacttgagaagctgattggaggcgactgatcattgtgtgtgtgaagggagtgtccctcctttgcggctgcacctgaagcatccactgttgtgtttctttcagccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcggtaagactgtctttgtaactttttctctccttcatgaaggacaaggaagccaggaggtactcttcattatgggagtaattcctgtgatcagagtaaaccccagcccgtggttacagatcagctgctggatgcaatttatttcttgctgaaaccacacacagtatttaccgtagagttgcctcattatgtggttcttggaggacatgcatttaatcagaagggagtataagttggttcagttacaaatcagaataatcagttacaggaagatagttctgttgtttcagaagggctctggtgcccgggtttagctgcgaatgtactccgcgtacgaggctggcgttttaatgtgtgtttctttccgaccccaagaatgaaaggttaaatacaggaagaacaagtctcaggagaacagttgctgtagtaaaaataattccttgatgttgacttgtactcttgctgtttctccaaaccactgaaatctgcacttgcagctttacattctttttgccttctgattcctggagcgtagctcttgccatctttttgactgggagtcgggatccaagtttggttgcagagagcacagaaaatgctgaacagctgaaaacacacacgcaggctagctcagacaggactgacacaggctcacggtcaggaagacatggtcaaaaaatgagatgaattttgagtttttcctgtttgcttgctctaagcaggagcaagagtgggattcccaggcctgactggaactgctgggcaggtgttaagtccctcctgccttttgtgctcactggtctcccttgagccttgagatccctgctgtgaggatcctaaccaggaactcacccatccatatggcaacccttgtgggccacttctgtctcctactttctggccatagcaatagccattgtgcctgctggagtagccagtgtgcctgctggaggcaagatgtgtgtgccctctccatgcatccacccctaccttcaccatcaccacttttgagaacaggcctgctgaacttcctctggatccagaccagggacacgtcttaaacccactgcgaacatggcagcagctctccaaactgacttttcataccgatctgtcttatggagccttctgtgtggaatctaatgctcgcacagctccattatccaggcacaaaatggctgtataatccattgttcattggcccattgtcatcaagtccttgacccttaaattgtttatagacctccctcaaataaagctttccatcgctccctcccctttcctgccatagggcaggctttccctctgggtgagccaggtaggactttggtaagttcacctagcccccagcctgtggccctggcatattctggattgcaagagttgtttatttcacatctgtcatccccacccccacattttagctcaagcttccccccctctaaaaacgtcaggtgttaatgggaatcatgaaaacacttggcagaagatcaaggtttcaggctttatgggagtctcccactccttttttaaaaacggaaacataagcactccacatccactaggacagctagaatccaaaactcagataataacaagtgttgctgaggatagggagaaccctcctacactgctggtgggagtgtaaactggggcagccactttggaaaacagtctcggcagttcctcagttcaacatccagttacgacatgacctggcagttccactcttgggtgtatacctaagagaaatgaatgtatatgttcacacagaaacttcttcatgaatgttcatagcagcattattcataatggccaaaatatgggcacaacccaggtatcagtggatgactggataaacaaaaggtggtatagccatacaatggaatattcattaggctgtgaaagcaatcagtagtcctgcaacatgaatgaactttgacaatgtcatgctaagtggaagaagtcagccacaaaagaccattagattatatgattccattcatagaaatgtccagaatggggaaatctgtggaggtagagattaggttagtagtagtttaaggatggggagggatggaaagagaggggtaatagctaaaatgtacagcatttctttttgaagtgatgaaaatgttgtaaaattgactgtagtgatggttgcccatattggtgagtatactaaaaaccattgaattgtatactttagatgagtgagttgtagtgtagatgaagtattctcaataaagctgcttttaaaaagaaatataatttatatatcataaaaatttacccctttaaaatatataaattgatggttgttataatagtcacaactgtgtaaccatcactattatctaattttagaacatttttatcaccactagaaggatccccataccattagtaatcactccctattctctgcccccaggcccttgatagcactaatctcattgtgtctccatcatttgcctattctgggcatttaatataaatggaaccatacagtatacggtctcttgtaactggcttttctcacttagcataatttttaagcatgtatcagtacttcattcctgtttttcatggctgaataaatgggtttacattttatttatccgtttatcagatgatggacattagattgtccccactttttggctattatgaataatgctgctgtgaaaattcatatacagggttttgtgtgattctcttgggtacaaacctaggaatggaattgctgggtcatacgctaactctgtgctcagcttttttgagggactgccaaactgttttccagagtggcttcatgattttacatgcccatcaccaatgcatgagaattccaatttctccccatttttgctagcatgtgttattaactgtcttttttattttggatgtactcgtgagtgtaaaatagagtctcatggtggttttgatttgcacttccctaatgattaatgatgttaggcatgttttcacctgcttattggacatacatatatatatatatcttctttggaaaaacagctatttaaatcatttgccagtattcatttgtcttttcaatgtttagttgtaaagttctttatgtattctggatatgagaccttcataagatacatgttgtgccaatattttctcccagtctgagggagggctatttttcattttcttgatagttgaaatgcaaaagtttttaattttggtgaagttcaatatctctattttttcttttattacgtatgcttttgatgtcatatcaaagaaactatttgcctgagataaggtcacaaagatttcctcctttattttcttctaagagttttataaccttagtgttacaaagccctttgattttattctttttcaaaattgttttgtctattatggatcccttgccatttccttacaattttttggatcagcttgtcaatttctgcagtaaaggaaagtgggatgtgggttgcattgaatctatagactaatgtgagaagtattgccatcttaacagtattaagtcttcccaatccatgaagatgggctgtccacccttttttcttagcttcttaaaaatttctttcagtcatgttttgtcactttcagtgtacacatcttcaactactgttaaaggtatttctgtttttattctttttgctattgtaaatgaaatccttaatttcacttttggattttcaaaaatgaaatatttattgcaagtatacagaaatgtaattgaattttgtatcttgatcttgtatcctgcatatatgttgacatcatttattctaagtttttcagtaaatttcttaggattttctttatatgtgatcatcatgtcatttgcaaaaaggtagtttcacttcttcatttccagtctgggtggctttcatttctttctctagcctgttgcactggctagaagctctaatacaaagaagagtgaatttgtgagagttttggtgggaaatcatgagacatccacctaaaagtcctaatttggctccatctgacttctttttagttattatctttaaaaatctttaaagggcacccaattttcttcaattaataatgtaaaaaagactgcattgatatgtcccaggaccctcagttctttagggatggactaaatggctggtatcatcactcaggagagtttcaaacttgatggaggttatgttgagaaataaagtttataattcggttttccatgaactttttgaagtcccctcatagtgttgttgaagtcttctgtttccttgatcttctgactagttctatccgttgttgaaagtggggtattgaagtgtacaaactattattgttgcactatttcttcctttaatctggtcagattttatgttttgtggcgctccattaggtatatatgtatttatcatttttacgtgtttctgatgcattgacccttttacattataaaatattattctgtctctgtagtaaaaactcctgtcttaaagcctattttgtctgttagtagtatggacactttagttctcttttggtgactgcttatttgtatctttgaatccacactgtgtctcttgtaggctatagctggatcatagttttttttatccattatggtaatctttgccttttgattggagtgtttaattcattttcctttaatgcatttactaataaggtagagtttgccccttatttcttctatgtgtcctatctttttgtttcattgtttttccaatactgactagtttttttattgaaaagatattttctgttgtactattttaattccctgttttttaaatacacgggtattttttagttattttcttagttttgcccataggaattaaaattaacatcttacaacaatctagttcaaataaataatgaaattaacttcagtaatatgcaaaaattatgttcctattaagatccagttttattcctttgtgttactgttgtcgtacacattacattttcattaagcccatcaacacagccttataattactggtttatgtagttgtcttttaaatcaggagacgcgagttacaaaaatacacgtatcctgtgtgttgtattacctgtgtagttacctttaatgggattttttatttcttggtgtggattggagttgctatatgatgtcctttcatttcagccatactaaatactctcctggatttcttgtggggcaggcctgataacagtcaacttgctctgtgtgtgtttaaaataaaaacatcggaatgttttaatttccccttcatttttgaaggataggttttttaatacatagaattcatagttgaacgtttttctttcagtaatttgaatatcttcctactgccttctgttctctgtgggttctggtaagaaatcagccgttaataataatgaagatcccttgaatgtgatgagttgctcctcttttgcgttttcaagattctttgtctttggcacctgacagcttgactatgatgaatctgcgtttggatctttgaatttactctacttggagttcattaagattcttggatgtgtggctgcacatttttcatcaaatttggggccattgttttgcagatactttttctcttcctttttctttcttctccttcttggactcccatgatttgtatgttgttgtgcttgatgctgtcccacaagtctctgtggttcttttcattttacctcattcttttttctttgtttctcagactacataatctcagttgactgtctcaagttccctgccccctccttctgccagctcagttctgctgtcaagcccctctagtgaatttttcatttcagttattgtacttctaagtttcaaaatttctacttggttcatatctataatttctctttattgctataaaattttctcatactttatccttttttttttttttttttttttttttgagacagagtcttgctctgtcacccaggctggagggcagtggcgtgatcttggctcactgcaagctccgcctcctgggttcatgccattctcctgcctcggcctccctagtagctgggactacaggcacctgccaccacacccggctaattttttttttttttttgtatttttagtagagacagggtttccccatgttagccaggatggtcttgatctcctgacctcatgatcctcctgcctcagcctcccaaagtgctgggattataggcgtgagccaccccacctggccactatccttcgatattttttttaagacatggtttccttgaggtgtttgaatatgcctataattgccgatttaaaaagtttatttagtgaatctaagtctgggctccctcagagacagtttctgttgactgctttttttcctgtttgagtgtttcataatattttgttgaaaattgggcatttaaaataaaataatgtggcaactctggaaattggatattccctttctcctcccccaggatttgctgctgttgctgtttattgttacagcttgcctagtgacttttcctggacaaaggctatataaagtccgtccccttaagtccctgcttgtttagtttagtggttagctaatggttggacagagaagtcaccacaaccactgtctcctatcctttaccgacggcttgtgtgtttgtgttggggtgtgccatcacttcctatttgtgtagacagtcatgctcagccacaggtgacaaatgaggaccccctcacgtctttcctgggtgtgcacatggccttgcacctgcatgtggctgtctagatccccaggaatgtattggaccttttcaaagcccaccattaacactgtattccccacattttcctttatagttttttggccagctgcttgtttgccccatgggtattgtcccctcagacagctgcgctgttgaacagtggctactgattgttgtagtcatgtgccctggggctagggcttctcctgctcggcaaactagatcagggcaaatcaatgcaaatcctgtgaatggggctttccgtgttgctgccagataggccacatggtgtcagttctgaggatggggcttttggggagcccattctgacccttgagtggttgctaggctgctgggtttcaaggctaccatggagctggggagggaagaatggggctttggataagttaaaataccacaaagctcacatttctgagatgttgctatttgcttgaatcaacaatccatggattgttgtaagcctttggttttccagaattctgaaaaagttgcttttgaccatttttccaggtgttttccttgttttaatggaggtgcagatttttggaggtccttattctgacattttggaagtgttttacaccccctccttttggagtaaggtttgtgggtaagatctctgcagtcatgaccagtggtgcctgactgttttgtgtgaaagtcagcaggcagagccagttgtcttaaggaaactgccggctggctggtttgagaactgagaagtggtgggttaatttctaatcaaggagtgtgatcataaaggtgatcagtactcacagacttctaattagatgaggtcagatgtccatggtgcaactcttacggcatctggttggtggggctgaggatgcacagggacctcaagctctggttcctgcttggtgtctgtgtcagtttctgttagcatgaacagcagctggttcctctgtgtaccaagaacccagcgctttacagttgacccttctctccccagatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatggtatggaaacaccatctttgttatagtaccagaatcctacaaagcacactcctgattgccctttcagctttccatgtagagatgactgagacaggacacacacatgcttctgtggggcactgttaaatcctattgttgcctgggtttgccccagagcaagttttgcagatttcaagggttattcacaatgagttacttgtttttggtgagttttaaaaatctagttattggccgggtgctgtggctcatgcctgtaatcccagcagttgggagactgaggtgggcagatcacttgaagccaggagttcgagactagtgtggccaacatagtgaaaccccgtctctactaaaaatacaaaaattagccaggtgtggtggcacatgcctgtaatcccagctacttgggaggctgaggcacaagaattgcttgaacccaggaggtggacgttgcagtgagccgagatcactccactgcattccagcctgggtgtcaaagtgagactgtctcaaaaacaaaacaaaaactagttattaagtcaaattgtggagagctaagccttgttttgtccagttcttatcctctataagccaagagatctggcttccaaattccaaataccccttagcctggggaagctgctgttctttgagtagatggcacagcattggagtcagaggctagctactgctccagagactgtggagtgcaaggctggtgtgagccctggcctgaaagacacagtgtcctggcagttgacaggtttttactcattaaccagccttggagcttgtcaaggggaccatgtgttattgtgtgtttggaggaggggggtggggagtagatagcttgaagagtttactgtcccaccccagtaacctaatggggttatcctgattactaactctctagttaaaaagaattggcttgagaatcatcagaatggtggatctgctttgctctttaagcccccacagatcacagcgaaacaccttctttaccacactgtagtggggttgtcttggcttattccaagtcctcacagcttccgaaagactcagctgtttgttagactctccccaaaattgacgttgacaggaactctggtggtgcctgacacgtggctggatgcgtcccactctgtcaggacatcgatctttaggctgagcaagctagcaagctgaatgcttcctgcctgggtatacggcagtgggcaggaacagcctgggtgaacaaccatccaaatggatgagccatcccattcatcccatgaacacccatccaaacggatgagccatcccattgctctcccaaggtggaggcatgcccaccttccctctgtaattccatctccacagcctctctcttggtgggtaaagcaggcaagcatcaggcctacctagtgtggatgggcaccccctgcaactcccgtataggcactgccatgtagagtaaaagcctttgctttgaagggactatagccagcctagggtgtacaatgcaaggctgatgggatggaagtgttccaactgtggtgggagaagctgggggttcctgattcacaggtggcaggagtggtcctgggcagacattgggagaaaagaagtgaactggcactgggcacagtgacaggtaggtgtttgccagaggacttcctggttttgcatctagctgtcccgtaacccgaccctgtatacgtatgttttccagtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctaggtttgcctattgctctactgtgtgtgtgtgtgtgtgtgtgtgagcgagagagagagactctcaaatgctctgtgtggccaggggtggtatgcgttgtgggcctttcgaccctgtttgaaatttggggctgctttttgagttgagttaatttttcttaaacaagtgtttctatctctttaaaagaaatgatagctggtgaattaagagtcttcatagggtttagctacagaacattttaagaattggacaggatggatgtgggcttggtcaagagctacagaacattttaagaattggacaggatggatgtgggcttggtcaagaataaggacacaggcctgacacaggacagttagggaatagcaggggcttttgtcagcagaggttcactgtccctgtggaagccactcccagcatggagatgactcagtcaatgagttgaagggtcttctccaaagcttgccactctgagacagaatctcagatgcatctcattgatatgttggattgtccgttgtccagaagaccgggcagagccagagcaacggaggccctgagaatgactaagatctctgttgctctcttgtagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacaggtcaggccctgccagcggagctgactttcaaggagggaggaatggcagtgatgctggggaactgggccgggttccagtggcttttgaaagaattgcactgtgttcagaactcctgagggtttagtcccactaattccattttaactttgaggaacttaaccttaaacaggaatactctcaaatttaaccttaaacaggaatactcacaaatacaagtaactgacgcaccatgcagttttccctctccttgctaactcagaggccgcctatgcacaggccctgctgccacgtagtaggttgttcctgaaacagtgcggtacttctgtgagccccggctttccatcactggtctccacttcttgtggcgtctggcatctgctggctgcgctcttcacgctgggtgtagagtaaagctgagcaggctctgggagggcctgttgcgtacatggactccatgtcatctctctgcacagcgctgatggtcgtcactgggaggatcccctttctgagcttgacagtgaacgtgtgtctgcatttcttgtcactgagaccctggtgttctatttgttctgtctccttgcagatgaaaccgtcgtgccaccagatgttccaagctacctctcttctcaggggaccctttctgaccgacaagaaaccgtggtcaggaccgagggtggccctcaggccaatgggcacattgagagcaatggtaaggcctcagtaactgtgaagcagagctctgctgtgactgtgtctctgggtgctggaggtggcctccaggtctttacagggcaggtacctggcattagatggggcaaacttggtgaagtagaaggcggtatgactaagggctgctattttggacccagtcttcatgagttctgcaaggttttaaagtcctgtcccctcaggaagccactggattgggcttagcatctccctggcaggataaagtaggcttgcctggagtagcagctggaaagggcattacggtgcatgaacccagccaacccattccttacatggggaacgtgcccaggtctgctctgtgatccagtcttacactggaaagctgtcaccaggatgaggtacttccaacggtgggggcctctgagcacttgcctgagactgtagaggctcaccctgagacagctgctcatttcacaaggccagcctgcctgctgggaagtagtagcagaaaacacgctgcttgccagaccagcagccccaccgctctgaagaactttttaaaaaaaatgactgttctagcggccttgctcattcctttcataaggcttactgtgaaataccaagcccagagtttctaatcgtgttggaatccacttgcaggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatgggtatgagatgcttcccattggaagtagtttctttctgaaatggaaatttgggctgacctagtcactacatcaaagggggagacacattcctagtccacagctgtctccaaatttggtattcagtatatacaggggaagctcaggcctggctctcttaattccaggatagtttctcctaaataaatctacgccatggtaagcctgagcatgaattttctagatgtataagcaacttaaataaggggcaaggcacaaacgaagtatagagtttcagtcagcactttttcaccagggctattttgaggcttatttctaattgttgaaaagacccaacactgcatggtacctaaggctaatggcttttcccccgtgaagcagtaagactacattgtctatgaaattcactgtaaacacgaaagaccccacagttcatgagtgacttggtgtttgcccagtcctttctctggggacatagttggggaaaagaggaagcatgcatacagtgtttgcagtcagggttctcaccttgcacagtggagctgagcagcctgtcctctgtgtggggacgaagactcccacagcagtgactctaacccatctttggcgctgtccttcagaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggtaacttttgactgtcttctaacaggtgggttgggagctgcttaaacggtcaagtgggggtctgacaggttcgttctttccttgtaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtc

SEQ ID NO: 37533 - DNA, 125981 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaaggtaaaattgcagcccctttcagatccagtacccaatccctcgcctcaggggttctgctttctttgttcccctaagagacctgactgctgttccagggggcaaaaccacgtaggtgggctagagtttaggggcttcggaaactgaagagacgtggccacggcgaggacgaaactagaatggggcttgtctttttagggggttgcttctgatggccacctgtatgacttaggagggagaggggcgctgggacagtgggtgatgtgtgactgttacggcccagcaagttttaaagctgggatctgactcagcccttacaaaagggatccggtcatcctcgtcccaccgtgatgcagctggcaaggtttgagccgagctgtttccttgttcccagccttgctttatctgtgttatgttggggtccttccaaggggcaggtgtttctgtgaaagtctgaattcatttctggcaatcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatgaagatgatctgaaaatgatgtacatcatgtttctctgtgctacagggacataaattgcatttttatgtaaacagtgtaagtggtgcttggattatttacaggtacatagctttccttccttgatctaagctaattgagctttgttttgaacgtgtaaacttccataatggaacataagtgaggtactttggttcctatcatttgcaagtctgtggtgtattcaatgttcattctttttgaactgctgaataacagagggaaaatttacatcattcataagaaattttggtagtacaaaaatgtgtctgatagcctataaaatgtactgctgttttaaaaattctattccgttttcaaacttaatggtgtataagctatagttattaacttaaatatattttgcttttaacatgatggaatttgtggcatatagaagacagtctgccgactactgctttttcaaaattgctttgttcttgatacatggcagtaggggtttacattagatgtatactacatgctttcaaaattagttgatggagtttatcttcatgataaaaaatgtaccagattaatcatagccagtcaatacgaaagctcataactaatattttcactacttttaaacctataatagagaaaaatgaccctttgctaagcaggagaaatacccatattttataaattccttttaagactatgtaagtatatgccttgcattaatcttgaaatctttaaaaaaaaattgtcttaatgagggctagactaagaaatacatttcaaaaatcaatttccttagctgtttttaaaatagtgtttgaagtagcattagtcatattatccttctgcagatctacataatagtctcaaattaactttttctcaaatgtggtcatctcaaaacaacgtgaataactcagaggagctaacatcctctaactggcttattttctccaagtggctgcaccaaagacatggcaacacccccatggtgagcacagttcctcacacattcagattacctcccatttctctgtcctcttcctcctcaaccctttcccttggtttggtcagagctgctttcaaggccttccgtgcccccatttctccagcccagtttgctcgtttcttctttaggcattaggcttagtgattctcgccagagccatctacgctttcttttccgtggtctaaatccctaagatttccttggtctgctgtgtttattcataggatactcaatttcctcattgtgccctcttaaggggagaaaatgtatgtagaaactcaagtgtccggaagtgagccttcttttcctggctggtgtatgctgaaactagtgtttttgacaccaagcccttagggcagagtttcttcatgggttttgctcagtgcaaaataaatagtcacttctcagtaataaatgatagatacactgactaatgttagttcagaatcactttgatgatgtgttctcaactgacactgagttgctgctagatccacatttgcctgaccaaaaatagctaggacctataggtagagtatcatatgtgctaggtactacagcattttctttaaaagaaagaaatggaatctgcccttgagaagtttatgatctagatacacagacaaatatcacatattaaatgaacacaaattcataattattaagaggacatcacatgagaaacgctttcaaaatcatcctatttgctatgaaataatagaatttttttttaaaaatcaaagtttggaacttaaaaaccttaacattttcaagctgtttctgcatacatcacctttctgataccaaaacgaccttacaagataggcaagtctgataacatcttaacattcttatgttatagacaaggaaactgagcttgagactagctccatgctatttcaatagcaccataccacctttcctcagccatcaactattggaaacattttccatggaggcatcattagggatgcttaagatagtggtaaatgatgaatataacatatctagtccctggagtttttgtcaccttctctttctccagttctctctctcttttttttttttaatttcttttcttttctttttttcttttctttgtagtgagacataccgagaaaaggtttcattcatatgtgtggggcattctgctcctgttatcagattaagagccgtgaataattttgtaatctatccttctatcagaaagcccattctcagatatcttttcagctgtgttaaacaggttagtatattccgcttgggatttgtttcaataaaaacatccagtaaaatctgactactttgcttttcatgggacaaaatgaaaaaagtgcttttataagctgtaaaacttaattgagagaaaaaatcacgtgtggcatttgtagcaggaggtatgagctcagtgaaataaaaaagttaactttgtaatcacatacccaggtacacatatttctctctgtgattgcataaatgtgtgcaagtatgtttatgtaggttactcccattgattttaatttctataataaattatgtagctatagggcccacaggcgattatataatgggcaatagaatttgaaaatgtatctctcctaatataattaaggatagcaattatgaaatgtgcttagagaatcacaagttatcgtgaaagccaggttcctgtactccaagaatgtgaatgaggatttagtcattcattcaggacaattttttgacaacctacgaggcatagttctaaaatctggcatttccacagagtataaaacagatgaaaacctctaacctcatgacactctgttctattgagttggcaaacaataaagaaatacataactgaaatgtgttgtatgtcaggtgatgataatagcttcaaggtagaataaaatggaaaagagaatagtgactgtcaaggataagagagagtgggatggtgattgaaaaactcaatagtgaggtcagggaaggcttgtcttcaaaggtgggctttgggctagaatctgaaggagataaggaagtgagccaggcgcatatgaggagcacttctcaggagtgctattctcatcttgtttttcctgaaattgtgcagttcacagcttgcacaactgtccatagactccctgattttggagggagatacctgaatagtgcccctgtttttgtagggaaatacctggacagtgcctgccatcattagctaccatgttaaagatgaagatacaggagtggcccacatctcttggtttatgagacatggaagaagaagacccagagtgttgttttgtttttttttttgtttttttgttttgttttgttttgttttgttttgcatccgcctggtcccatcccatactccatcctctatcagagatattgctccattcagacaattttccttcttattttccacactgtgagcctgtcacagtgggatttgttgagaaggatacccatggcttttttcactgatcccttccatagtataaatctaaagacagcaagaggcagttgctgatggtgtgcagcttctgtctgctatgcacttctttctttccccctcgctctccttccttttcctttccagtattaagtcactgcattggattttcttcctcttttcttccttttcccttattcccctatttatatcctgtatcaagatttgcaaacaggtaacttaaatgaggaaaactaaccatttcactagggattgacaaactgcttaggaaaagcagaggggcagtcactgcttggcgtgattagagctgttgtgaggctcagtgtatggcatgggcccatgtggtagtatctttcagattttcaagagaagctaggactctcccaattttaaaatgttgactcagtgtctttaaaacaccatacagcttacagtggcagaaagtctgcaagccagattgggctcctgatggtcccaattgcagcagcatgcatggcccgagagccccaggactgcttctacaaaatattttattttctaaaattctcagaaaattaactaaacaaattttttaaaaccaatattttatgtcagttcctattggcacgtggttatttttctaaactcatcagcccacatactttacatcaaactatgtacgtttctaaactaaagggtaatctagttatttcattcttaaactgaagtagtagttttctgaaacctgaatccatcatggctttatgcatcaatttcatttccaagttctctgattcaggataaactccccctttggaatattgtctttctctctctctctctctgtctctctctctctctgtctctgtctctggaaatgactgaacttcacccgttgttattaccctgccattgaaattcaaaacatgcactgccctcctggtttccagtgccctttaaaagcaatcagatcagtgttaaaatctatttttccaaaggaataaaagctcacaggttgtgcactaatttgtttcctttaatcctaaaatctcagtgaaatgcccaagctagcagccctccagaaggccactgtgttagaaagggagattatgtactgtatttcttcctactattttaaatgcaaatataataatatatcatgaaacagtgcacatacagtatacatattaagatcagtggtctattcctgttttgaaatggtctcctactccttaatagttggaattctgaggcagcacctagactctcaggtccaatttgaaaatgtatgtttttttttaaaaaagaatgacttggggaataactgtttgataagaccgtggaagatttctaatttttaatattttattaaaaatgtaaagaaagacattcaaagctgagacctttgaaataatatggtctttgcaagtcagagaaaaagagaagtggtaaatttattagagataggttgcctcctttgaggcctaatcatgtgggaaaggaaaacccagccaaggtttgggtccataagacaattcaacctagctttaaaaataggttttggctttgcttgggaccagcattgggaccagagtgtatctagaccagcattttagctattaaattttaaacctaggggtcttttaagggaaatttaatccatgtgtctttgattcactaaatcttaaatcattactcacaaactgtatgtccctctaagctctttgatgtccaagagatctctaaaattgtgtaaggcctttttgttccagaaaaaaataggaagttggtttttgctaagcgtcaataaacagcatcctcaaaaatctgattaggtctaaaatcttgcaaccatgacagtatggatgtttgaatgatgcaatgtgaaaattttaagcactttttaaagtccttgtttaccagtaatactcagttgtaatccttactaaccccaaggaaattattttgacacatttcctctctgttttgtaatataaatacaaagcccaaatattcatcattttattctggcacatagtaggtactcagtaagtattttgtagagtgttgaatgactctttcttctgcccagaaacttctagctaatgtcagttcttctattcaatattgatatccatctgtcataccttggaataagatctattctaagtcagtgaccttgttcgacaaatttttaaaataagccatctaactaaatatatgacatttattgaaattcattttgcaccatgaagcaactgccttgcaaagagtgctgaaaataggaaggaatttctagactaatttgattaaatattcagttgttgccatatgctttctgaaaattgattttcccccttttactattcctgtcatccttcctcccaccttgacatgcttactgattgaaagctatgcacagaaaaagggcaggtcgcttgtatgtataagcaagagcagcaagtccaaacaggcttagaaaacgtaatgctataatcacgagttgtcataatataggagaggggagagaggaatactcagcaataagagtggtgttgggtattgctccaaattacatggatgacacatctttgaactctattgtgtcgggggaaaacaccttcttgctgtagttagatttcctgtttgtgaatgtgtattttctggtaaccagacttcctatatgaatttgacatagctttaagtgcatttcaaatgacatgattaaagaatggctgctttggagacagcagctccttctctcttaaagaaataaactatcatgctaaaatataggcattgagatctttcttgataccatattgtgaatttctaatggctcatcacatttttatcctcagaaaacctttcctggtgaaaagcatgctgttttagtatcacatttggggtgatggaattggcaatttcttatatcttgagggggcgggggggtaaaaggaaaattgtgttaatagggtcttaaaatagagattctcttaggttaacctgaagatttactaaatacattatcattacagcttgttttgacatttaattgtagatggcactgtatcagcactgacttatttatacagctttgtttagacatgcctaatttttatttcattggtggaaccaaaccatcagtaataaatcatatatcagtgtttttgtacacattcgtatttacatgacttttaaaattccaatgtaaaggtctcacaacttgaaaaatgaatgaatgcctgagtatttgaacagttgggaaaatgtagttcaatttaagaaagattttttatgacaattcttatgccatatatagaaaatagataataaaggagaaggcctggaggtttagatgggatattggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactcccaggcactctaaatgaaattccattttctctgaggaaatcaaaatataaaaagaaaactcaggcaaatttataaaggttttacaccattttcatgactgaaatattctagcatatctagctcattataatctataaattcctgttgggaccaaaagttatggccctaaaacctgttatctgtaatccttttccactgggatattgtctctggggatatatattagctttccttgaggatactaccttgaaaccatttctttggtccttgactatacaaagttcatactagcatggatgtaggaattgtatttttctattctaaatacgaatttagacagtgatataaagattcaaggaaagcttctatcaaggcctgccttcactacttgtcttttggctcctctgagggtcttaggtgagccactttcatctgattctgccctcacttcaggcagaattcatatggctccagccaatggctacactgtccaaagtgagactgtggtctcacaaccatctggttaatacaaagacagcaagccaatatgatcacttaggacctaggcaaacctttgggcttaaaatattaccttagctattgttgtttttaatgagtatcaaatagtatgatatttgtaatttgtattatgtaaagaagtaaccaaagcagagattgttgacaaaaaaaaaaacttcctcctaacataaatgaatatgcattttggacttttcaaaaattccctttctgtcttgtcaaaattaagatatttctaaattttatttcggtctcactaacacatacttggattattgttcattgaaatctgtacgtcaaggcccagtgattttaaacattcttttggtcttcaaagaacttaccaaaaaaaaattgttctttaaatcaccagaaaagtgcagataaaatcccagacagtttcattaatgacaatgaaaggtgacagcccttgaatctatgtcataagttgattaattactttccaaacattattaaagatattagacgaataacttagactggtatccaggatcaaggttccttcataatccctaaatgggttttaattttcagagttagatgatcattatatgtgatttatttctttaacatctttagactgttggctttattgaaaagagaggagagtatctgtttcaatgtgttttcttttccctgaagttattccttgcagaattcaataaaaccggttttgaaataaaaataattaaatgctggcattttctgttaataagggcccatagacctgatgaattatataaacattacaaggaatttaccactgagttcataattatgtaaccatttaatgcccaaacctgcctactgacagtgaagacgttcaatgagaatggacattgtgcattaggataaggatgacctggagtgaactttcattcttgttttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccatttttcttttttaaaaaaattatattttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgagaacatgcagtatttggttttctgttcctttgttagtttgctaaggataacagcctccaattccatccatgtttctgcaaaagacagaatctcattcttttttatgtctgcatagtattccatggcttctctatttttcattcacctcttactcaacttactgattcttctagaaagaaataaaacacacacatcaggcatcctgataggatcttgaatacacaatttccttaagtagtcactcctgttttcattttagcctttaaataatgaattcttgaaaataaatgtctaactcagtttctctactttcttcattcccattcattcttaagtcattcaactcaagcagtctgtaccacatgcccaagaaagtgtcctcattctaatcaccagtgccctcctcatggccagatctgatggacactggtttttatcccttttgacccgtctgtagaatttgacaccatacattttatttctcccttctcgaaagttctccttagcttatctctccacattttctttgcctacaattgttctttttaccctttaaaacataaaggttagattctagtcttctgtaaggctccatctgaattcctcctttctacttacaaaacacattcacaagtgatctcacttcagtgacttccaatacaccgatggacgagtggttcacaaaccgctctctctcacttcctcttttctctagaccaccactttcatgttgtcagctaccttacagactccaccacttagatgaccagaagctacatcagggttattaactcaactaattacttttaccctcaaagtctcctctccctattttccttaccttggtttatgatacccagatagacaattttttagccattcttggcttttcagtctcctctacaatcaaaatccatattgaataattcccacataatttttctcactttaatatgtgtataatctagtccttcctttctttccataatgctagaaactttgttcaggaacattcttttgtatattgattgattctgttgtccattcattcaataaatgcttactaagtgccatgtaatgacactatgctaagggctaaaagtggagcttacactctgatgggagacacagataaataagttactatatagtgtggtaaaggctagataaggggaagacaggtttgatgtttgagcacataggagagttcctaattccttactagaaggtaagagatgcatcagagaaggcttcccagaactgttccctaagatgaggcttgaagagagaggacaacttatccatgtgaagttgagggcaagaatatccataaagagggatccacatgtgctgaaacccagagtggctgagcacatggcttgcttcaagaactggaagagggcagagtggccagagcctagatttctaatggtgtgatggcaagaggcaagactggagagtggggcagaaaaaaatggtatgtggtttgtaagctctgccaaggggttgacattttttttcagcaaagaagtgacatagtcaaattgtcagtttagaaagatatctctggtatgctagggggcagatgatcagggtgagaatggagagggaagaccagcgaggaagctgttgtagtaatccaggtatgaagtgacactgccctgaccatgggcatggaagccaataaggagatggacatgtttaaaatatttgtaggtgggtgtcaaagatgatgtcctagaaatatgggacatgttcagcactgaggtaggatacagagagggagaccaggttttgtgggagtagatggagataacagaaggatatccaactgctccttcttggtctcttgtcccatctgtctttgtctcctgacctattagctttggtggcgccatcactcagtcctcctctcttcattctctacagtccctctcctcggagatcccatccactctcatggcttttcatgatgtctacatgctgacaacttcttaatttaaatctctagcccagacctttctccttaaccccgggactcaaacatccaactgcatgcccggcatctccacttagatgcctaaaaaatgtatgtcaggctgagtgcagtggctcatgcctgtaatcccagcactttgggaggctgaggcgggtggatagtgaggcgggtggtggtcaggagttcaagaccagcctggccaacatggtgaaaccccgtctctactaaaaatacaaaatttagccaggtgtggtgatgtgtgcctgtaatcccaactactcaggaggctgaggcaggagaatcgcttgaacttgggaggcggaggttgcagttagccaacaccacatcactgcactccagcctgggcaacagagcaagactccatgtcaaaaaaataaaaataaaaaaacctccattgtgggcaaaactacattcctggtctcctcatatcctacaaacatgcttcaccaaccagagtctgcatgtcggtaactggcaaagccattctctctgttaaaaaagtcaaaatccttggcatattctcctttttttctcacatgcctcagatctgactccatcagtaaatccggatggagttcgatctgaggcatgtgacaaaatagctctgtcttcaaaatagaaccagaattcggccacatctccccactctccccttccttcctggcccaggccaccagggtccccctcctggaacaccactggagcctcccagctggcctcaccactccacctttgccctgaactgccccccagccactagcagtcttctctcccatatgatcgaggtgaatacattccaacataatccccccttgttcaacaccctgcaatgactccccatttcactccaataaaaacctgaatctcccaggggcctacaaggccttacatgctctgcttctttgtccttttgatctcagctcccggtcaacaaagtccaggcttactggcccccttgctgtgcttcagacacaccaggcacatttagttcttccttcttgcctctgcccagaaatctcttttcccatctcagacatctgggtccacaaaagccaccttcccaatttccgagctacaaacctatccccatacctctcctccaggcagttctgatgccccagccctactttttgtttttccctgtaacacacatcaacttctgaaacactacatcatcagcttgttatgggtattaattgttgtccccagctaaaaagtaagttccacaagagcaggggtgttgggttttgtttactgatgtatcccaagcatctgatgcatagtaggaccccagtaaatacttgtcaaatttggtcttaaatagctgttgcatagacaaaagtgatattggagagatggatttcgggattctctggagatccttcaacaaaacatatcagactttctttaatgtggccacagcctaatcttatacctttttccactgtcaacccagcccacctggcctctatgccaattgcagcttcctggacaaccctgcatcttctccccaggtgcccgtgtgtgagtccactccacccaaagtgtctgtcccctacctcagctgcacctgagcagctccaacttatcctgcaagacacagctcaagtagtatcccctctgaaatactccttggccccgctttctgtctgcatagttagctcttctcccccgtgctgctccactgacatgcgcacacctttacagcacagcctgggcgtgttgcaggtggaaggtggagattcccagtcaaggggcaacacctgtatggttggaaaagttgtttgttttaatttcttgccctctcttctctcttctatttctttcctctcccataaatacacataccgcctatatacacacaacctgccctgaattgttttccttgaattgatgagttacgtaaatgcaatcctaagcacagttgttttcaggttgtcctaaccttttgctttattgatttttcaaggatccagagtgtttactgagtttcagaaattggattctgtacttatttttctgtactatcctagttttatgagaatctatttgctcagcattctctattcttttaaaagtgtttaagatttttgtaaacagttttgtttggttctttattttctggtgacatattgatctcaacataatgctattcatatacttttaattcttcttccaacactgttaggattgcattatgttcacccaaggaatccacatctgtacaaaatgtggccaggtttggctattccttcacattcacagtattctcatgatttctaacaattcttgtctactttgcctaaataagaaaatgtcatatactgacaattttgatcgtgaaaaagagaccttagttcataccagtgtcagagtctacttgcaaacattgatttccaagaaaatttctcaggtgtgagcaaataagcaaaataaattcagacctaagagaaaatagcactacaaggaacgcccagctcattcaaacgctctgcattttgagactagagggggcttggcctttggcaccctcacacctctcccctttgtctctctgtccctgggtgctgatttctctttctttgtgtgacagccactgtgaaaagaatggggttcactcaccacctgcattcctccacagccatttgatatctgctttcgataacagcagaggaaactgatcagtcatataaatccaatcctgagcatagttcctcgtttggaattgtaccatgctttatgccgaggacattttcaaacacggagggaggggatgtctgattcattcgtgagtaatgtaccagcttcctctccaacttgtctcccttcagtggttcacattctgactattcagtcggtttatcctttccaaacccagtatttgaatgcaactggcaaaggttgattgcctctttttttttttaatatatagacttggaaagatgtttctcaaatgtgatttgcggatttatgttattcagtcttcctggattaattgaacaaaaactggtaacactgctacacagtctgaatcacaaaattatgtccatccatttggctgaaaaatacgaaaacaaatacttgtataagttttcatgcattttagcactttctttacattggggaagttcaaccttcacactttcaagggcaatgaaacatttttgtctgacctacaatttattaatgggacaaaagcccatctgtcaatcagggctctgagagttcaatgtattttctgaacaatattttttacattatgtacaatggtaaaaacaaatgtccatttattcttctttccaagaagttgagtactttcaaccattcttaaaaggacaaagatgtttgctgacagaatatgaatttataaaggataatcttgaggatataatggcattctattctttttatctttactcttgccatatcagagttggataatagtctcaatcatatgttacaactagaaaatgcacaattggctttttcttatgctaacaggcagccattttcaactttttaaatgattataggactaagaggggatgcaaaaacagataagaatctgaataaaagcactatctgtcaaagaaacaacatttgtgtaataatcaagaaaccgtttagagcaccccctggaaacattaattataacacatgcaaatcattcctgtacaaagcttaacttgtttatctcctatagccacctgtatttgaattttttaataagctcatttattataaataaagcatgtaaatcaatctgggaataccttttctgtttcagaaatttcatgtaaatgacaggctgccacatacagtacaactatagaggggaaaaagtttctttactccctttcatatagttataccttcatatgacacttaaaaccacctgccaggaacttttaaaacatgttttagatgcacagaagcaaacccaaatgaaaaaatgctatgcagttttgcaatacatatataccacagaaagctttaaaaacattctaccccaacagataaatagatttggcccaaatctttttaatgtgagttttgtgggtaaaaaagattattgttcccttatttttccccatttgctgacgactaggattgtcatataaaatacattcctgggacatgcttatactaaacaaattatccactgtttatctgaaattcaaatttaactcagcatcctatatctttacttgctaaatctcagttgggatatgggcttactctttttttttttttttttttttttttttgagacagagtctggctctgtcatccaggctggagtgcaatggtgtgatcacggttcactgcagcctcaacctccctagctcaagtgattctcccacctcagcttccacagtagctgggactataggcacatgccaccatgcctggctaatttttttattttttgtagagatggggtttgcccaggctggtctcaaactcctgaactcaagcaatcgtctggcctcagcctcctgaagtgctgggattgctggcgtgagtcacagtgcctggcctgagctaactcttttttaaagagttaaaatactggttcctatttgtttttacttctctagtatgggaggctgttactgtggcttctgtcttggggggcaattttcgaagggcttcaagaacttgaaccgaggttagaggaaaaccacaagatggctaaagggtgggaaaagaagaaataacactatttaaactttagatgagaggactaaagtgatgaaacagtcaccaggtatttggagtggtctcacccaagggactgtgccaacttcctcattttttatgagggcaggcaaaaactggccaaaacacaagttaggataataagcatagtagctattattaaatgctagggtgtgctgcataactgaaggacagtgtttctcacagtttatctccaactctcatggccaacccatgagatgtatatcattatccccacgttttgaatataagaaactgacactcaaatcagaaggcatgtcagtgaaaaaggccatattcacatcccatctaagtctgtctgacactaaagcccacactctctccactacactccaccttgtctccagaatgttttgggctgtttaaatgtgattataccaaagagcagttgaatgcactgaaaaattctgaagattcctcctgtcccttcgattcactgttggaaaccattgtcaaggtagtgtctggctacgatagaagggatttttgacatggcctattgttttatctttttaaagtaaatgtaggtgcttttgatgatcataacactaactgttaagtctttaggcataagaatcaagcattcaactaagcatgtttacaaatttgctttcagcccagtggatctatccacttttccatttaggttgcacatttagatttcggagtttatcctgttatcttcaaatccacggactgtacactctttgagggaagaaactcttagtatctagtcaagtacgtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggcaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttctcaaatgcaaagtgaaatatttaaagtaattattcaagtaaataaagagaccatctttgtcccaattacttgaatattttacgtaaagttggttttatgcacttgactttgtgtttaaactcaagtttgtagtattgtctactggacattgttagctcaggaccttttcaggagcaaggaatgaaagaatcatttttaaacttatttaaaaaaagaaataaggaagaaaagaagaaattttactggctcgccttagcttaagacatggctggatacagatgctcagacaatcacatcaggagcctgcctccctccgtgtctgggctctctggcctcttgggtcagtttcatgctcaggctggctttctccacatagtggcaaagatgggcatcagacatcccaagttaacatcatctttagtgctcatgctgtcagaatgaaagaggccctctcccagcatccatattaaatctccaaagagattctgtttggccttgctttggccacatactcaaccctgaccaagctccgtgtcaagagaacagagttcgttgaaaggccagcctggtttgcacactcattctgtgttgaaagatgtagaccatgtgattgacagtcccaggagataggagagggagaattttcaaaagagttgccggtataagagacagtggattctgggaaggtaaaaagaggtatttattaaaatactgtgcctttggaataaaaatcttttccaggaaatgcaaataatttaaaacaattcaaataaggatcatacattttaaaacaattagaaatacactcagaagaactgaattgctcatttagtagatttcagataatattttctcctctttgaacctcagttttgtcatctggaaacacaggataatgcttaccttataaggtaatcatgattagaagagatgatggagctgaccatatctatttactataaagtgctatctacatagttataaattatgacagctaagaaaattaatccctaaagaaagcaaaattacctatgtcacggtttagaaagtctctctcttaagaagaaacttattctattgcctctgttgggttttttcctgaggaatcggtgtttgaatgcaatatacatttttgtaggctctgcaatgtttttatgatgaggacagtcatagtgttgacaattactcaatgaatacttagagatttgaatgtatcgctagatttctgggaaatgaaaagaccaatgtaagctagttgaatgagaaaaccagaggtgggcagatggtggacagattaagtcgctggttttaaaggtaggctgaactggtatttgtaactattaataacagccatcttctttaaaggaagtactcctaaatatcaatagtttagtggccaaggtgccattgagatgatcactcccaggaaatgttttgccagtgatattaccttaactttcatctgaaaagaaataaagaaatgttttatggatgattcactttcacctgatatgtgcacaacattttaagagaatgaattagtcagtctgtttgaatcatctttacgtgttccttttagcagggaactcaaagttggttaaatggctagctctatttcagaaagcaaaaataacagaaacagtgaaaagacagtctatattgaaagcctgatccagacacatcatgggggaataaatatatcaggacaaaaatatatgaaaagtgaaagtatttctggagtatttcactaccaatataaatattaaaatgctcacacagccagatctggcaagttacatagatgaggaagtgaaagcaataatatgccaagtcaatggcattggtgtaaaatgtaatcatagaggaacaatctcagagttgaaaattattagaattggaaaacactttgaagttctttagttccacccaggagtatgccattaaatatttaataaccatccctctgcgggctttaataacaagccctgatttgtagtgtttgccaatttctatggtgtcaatacagccaccatggctgattttaggctaccaagatgaggtcactgaaacacaagttgggaagagatgcacatagtaggctgtcatgagccagcacacagctggttcagcattataattttcaaataagaaagcagttgacctcagaggagttgggtgacttgcctgggtcatacaaataattagctgcactgccacaactaaacctaggccctctccagtgtttgacctcagaattgtgaatgcattatgaggaaagcaccatgattgattgattggtaagcccacgtgactttctgtcctagttaagttcccctttaagggcctccatagacatttctacattgagtttaaactatagtctgcctatctccactactggcctgagatctcactgacatttggaaagcgttttatttatctttgtatcttcagcactctgtacagtatctgacacttagatgcttataagtgtttgttgggggccatgtacgaacaatagagaacatgcattgacctgctatgtgccaggcagtgttcttagtgatttacatgcattaacttattgaatccttagaataactctcacaagtgaggtaggtactataatcctgcccatattttagatgagaaaatacaggcttagacttacttgcctaaggtaacatggacagtgattggatttaaaccctaaaatctggccagtgcctgtgcacttggcctctcagttgtcactcatttaactagcagttatcatcatagtgcccagctcagcgccaaatacttctaaaaggtctccctcctttccttaggaaggacacaaaacgtttcccagaaaagatctgatctgaccaacacacacctttgttaatggggaagggcctttattaatgggaatgatcaaggaaatggggcgtttttggtgattacattttctcattatctgaggtttaaacagaaacctctagtttaattaaaatttctgttgctgacaataggccctagtcccatttttttctttaattaaaaaagttaacctttttttgatgtattcacttgaaaaatggcatcaccatatggtaacagataatgtaaagaaggtgtaggagattaaggtactaactccaactgtgttctgtgagggtttttctttaaatagaaaatatattcttcttccccactgattttccatttcatcaaatgaagtaacaaaaagcctatttctacatgtgtacattttcttggattcttgtccactgagatttagtacagtgtgtgacttatgtgcgaaccttaagatatgaatcttattttaaaaacataatttaatataatatctctaatttttttgtttttgtttttattttttttagatggagtctcgctctgtcatcaggctggagtgcagtggcgcaatctcaactcactgcaacctccaattccctggttcaagagattctcctgcctcagcctcccaagtagctgggattacaggcatgcgccaccacacccagctaatttttgtacttttagtagagacggggtttcaccatattggccaggatggttgtgatctcctgaccacgtgatccacccacctctgcctcccaaagtgctaggattacagattattttgaaggctccttcaaaaagcctagaagaaaaaatgtcattcacacttcacactgcattaatggacatcaactaacatgcaaattggttacaatatttttctcccttttggcaataataattcgtttcctttctttcattataatttctacagaaaatacagcaataaattatatattaagctcaattttgttagatacactgataccatattgataagtgcagttaacttttcacataatatttatttttcccattgtgctctagatggtttagatacatatttgcagtttggtttacagtttgtatttgccctctagtacaacaaattgtccctaatccttttcttctatcccttgttattccctctaccagcaccaaaaatttgctagtacattgcaaaacaatgagaattacagataaaatagcaagcatttatatatactctatattgatcaaagtgctttcagagatgagatctctttttgatccttaaaatggtcacgtgagaatatctgaccctgggactcagaggtgggtgattgcctggagtcacacagctagagagggaaagggctagaatcagagggctgattgtctgacttctgttctagtgcatgctcccacctcgctttggaagctgcttcggcatagtgaagcacttaagagcatggatgggttcttgttagccagacgtggaattgaatcttggttctaactgtgtgattttagcaagtttgcttatctagaagagaaggataataatacttccttcttcacagggtggtgatgaagagtaaatcaaagagtttagcagaatgcttcccatatggtaagcactcaatacatgttcttgttatttttattattacatggctttgccttactgaggcttcatcttgtcctctggtccaactacagttctctagcttggcttatcccttcataacctgtacccccagtggcacgatcttggctcactacaacctccgcttcccaagttcaagcaattctcctgcctcagcctcccaagtagctaggattacaggcacctgtcaccacacccagctaatttttttgtagtagagatgggggttcacagtgttggtcagcctgggttcaaactcctgacctcaagtgatctgcccacctcagcctcccaaagtgctaggattacaggcatgaaccaccgcgctcagccaggaattttcattctttatcctcctttgagactcggctctagcatcatttccagtcgagttggtctcccttcctctgcattctgataactgttaaccatcaagtgacttgagcttcccagggaagggcatcatgtctttgtagacatccaataaatgttagtagaagaaaggggggtcctgccaataatcatatgtctttcccacaatttaaactccttttcaccctgttactactttttgcttgtcttccctttgataaacattctacttcttcatcacccattccctcaatttaacatctgatactactatagaaactactgccttgaagatcaacaaacgggttccatgtggaccaacgtcctccttgagaccctcacttggcttttgtgacacagtgcaatatttgctctcttgatgcctcactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatcatctttgtttgtctttgctttcttttttgcactgtgtttgatatattagggtatcaaatcctacttattcaaatatgtcccttattcattccttctatccttggtgctaccatatttgttctggctcttgttacctcattatgggatataaaaatagcctgtcaactggtctttccattgccaggatctctctgttctaagccaccctgcctccagatcaatcttcctagagtaaaaccttcattgtatgacggtctagctcaaaattccttaatgattattaatcacctcttaaagtccccaattcttagactattagtagggtaaaattatttttgatttggagtcaaaaaattttggacgcaaattttggctactacacttaaccattatgtaacttcgaatttcggcttaatttttattcatcatttattcagtatctatttgtttaacaccttctgcatctcaggctctgtactaggtacttgggatacaatgatgagccaagcagaccttgtccttgctctcctggacctcacaacatggtgaacttgtctctattgctcatgatcataataatcctaagtacaggctgtgcttttttcccttgatacttgtagcttttggtttgtgctatgcagggtattgtaataccatttgcagtgccacaataatcagcatatatgtgttatcactcagccacattgcagcttcactgaagggcaggggctatgtcccatttctcatagcgcaagcacagtgccctgcacataccagctgctcagtgatttctgatgtggtttttgtagatccagggttagtctttggcagtcatgatgcctagtatgtttttagaggctccctttgtcctatcagaattatgctatttaaaaaaaagtcatacctatttagtttatattcattctaaggcctctcctttccaacctactaccctgcctataactattataaggagaactcacaatgtttataacttgtgcaccttaagttttaaatactgaataacaggcccattcatgtttcctcatagaaatactgtctatatgcatacaatgaaatgttaaaataatgttctttttactaaatagctttttgacttggtaatgaacaatatgttgtttttccctgagaagtagttctaggactttagttctgaagattatgttgtattttatacattttcagcctcctgtttttcagttcccagtgatcttacattaaacatttgtctgtctaaaacaataggttaactatagccaaattataaccataccattcctctccacacaaaatcctataaacagcatgtgatcatattgcttctagaatttatgattgttttcttccaaaaggaagctaaatttagcctagtaattctacatgcgctcaagaaaacaatgcctgctgtgatttctagaataaatgaatgtgaaccacagttcctttacttgactaacagagaaagtttaaatatcaacctagtcattaaccacagttattaaaccacgttaaacaaccagcaaggggttaagaaagaaagttgctatgttttttctttcattgctgaatgagtctaacttagttactgtatcaaccttaatacagaacattgtttgcatctcaatggttctctaaaattattcgttcatggcttgagttctaaaattaaactatgtggagtcatgtccaaccgcacaatgcatctttatgtgaaacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtaaatggtaactaaaagaaaaatgtttttacaattcagatttgcatgttcgtgacatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatctatattcttgacattacttaaaggaacttaactttaaaaaacctcttctgaaatgctggtaaataaaacatttttaaatgagctcgtatacttctctaaataacctgtaagagtagagaggaaatgtttgttcccaagtccttcctttagagcttgactttaatcatggacttccttctggaaaagacttgtgtctaccaagttctagcttggcactttacctggttggtatttgttatttataagcataaatattttggttgatgattatttatacttatatgaaatggtattttcttaggagctgttagagatattcttggtgctgtgatttaaatatagtaacagctaccagctatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcaatctaagatataaaggttataattgcaatcaggtagaacattaaacatgtcctcagtagcataaagtatataatttgctgaggggtaaaggcatatgaattcagagacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccttttctttactagaaactacaaaagaatgaaaggaaacaaaatgattttcagaaacctgggattaggaaataaaaatataatattaatagcattacagagaagatatttttctgcatccagtaagttgattctgagacacaagttttaaaagagtctattaggaattcctccagggctcctagagcacatggatttgctatttaaatctttctttgttaaaaattaaaaagaagggtagggcaagaaaaaaattaaaaagagaattcataaaggtatattgatatctcattttttaaattttgtacatttcaatccttagatgtaaaaatacttatcaattctagaaattctcaaaacacatctgaattttatcctacccttttgacttttttagtgttccaagggagacaaacagacaggattagccaatgaaattcaggtcagttttatcgcccaggaaaaattcccaaaatgcactagccacacctgaaaccattatcactcccatcacaaaaattcttgcgggaaacaagatggaacttgccaacatagtcttcttacaaaggaagccaacttttacactggccaaattccatagacaaataccttcaaacctcctctatttatttgcctgtttatcttctctggttacaaagatcaaaattcttctgagactgagactacacatattctctctctccatataccccatccagacctcagattgttccaataatgagcatataatcatttcctagcttaatgccaaaatgaaggcacctagagccattcatcacacacaaaaaaaacaaaatgattacaagatcaaagctgtttagcaggactctcaagcaataagatgactccattttgtcttggcagatttacttggccagaaatcaagtgacccttttaataatttcttggaactgagtttttactttggcatcaagtttggtgaaaagacacacatattgtagttttgttattaacatctctaatacatttataaagggactcttgtggacaaggttaagaaagctgagctgcagcagtaactttctacttatgcttctgcccagtcctcagtgttgacacattgctgaaagagggatttcctggcactccaagagctctccaccatgtgcaaaaagtgtttctatcacaagatcagataatgggagtgccagggacgggccttttacattttaggggtccagcaggtgtaccaggcctgacttgcttgtttaggatcacatattttgttgcttttcccagtctcacatttcatgaaatatgtctatgcaaactcttcacatgcatcttctcatattgatgacatcacaaaagccctcttttgagtcatttgataattcccagtactcgtcatcttcacccataagctatttgtgcttcagaactctttgtctccacatatgatgctgtttctggaaacttatcccaagccacaaatgcccacttatagaataccagtgttgttgactatgtcagttgttctataagaatatattcttgatcctcacaatgtgtccattttttatgttgcttttgaaagtgattctaaagaatttgtttacagtgacttccaatattgagtactatgagattatacacccacaaataattactaaatctgtttaatatctttacctcctcctttacccattcatcaatcaacctctataagcatcctaaattagtattgattgaagttgttttaggctaatgcatattctctaaatagcatattattattcaaaataaaataattgagaaaattgtcccataatatggatggaacctttgtaaaggcccatatgtagggagaaaaaaccctcatctctatttgaggataagcagtagcaaaaatttcattaacttgtttaaaattaagtggaatttaattttaagactgtggaatctctaacagtcttttacatataagggattgattaatgtgacaatttcaggaaaaaaaggagaatcagtacacattggcccaatctcctacaaatgagaatcaatacagaataagagaattttttaaatccccaaatcagcaaagatcctgttccctaagttatagaatatttattaaaacaagtgaaatcgtacattttagaaaaaattttaatcaaagttgaaattagaaaagcattcttgaaatagctctcgcctctcagaaaatacaattagcacacaacactgtttttcttgaagttctattatcaaagttttgctctatagataagcatttgaaagacctgtagcaagtattttcgccaacatcttgatgaccttaatgaccaaagttggatcaagtgaaggggaaaagcatttggtgccagacacacctgggtggaagtcctggtttactgcataccaaccatgtgacttctgccacattacctgacttcttggaggctgagtctcattggtatcatgcagataacaatacctacttcacaggtttttgtgaaaatttgggataatatatatgaggtacctggcacaagatgactataaatttagcccgttgggagacagcatggactaatggaaagagactaaaatcagagatgttggttcaaatctgaaccccaccgtcttctacctggatggccatgaaagcattatttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaagagatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagtagccaactgcttcccaaaataaaggaaacttaaggtagtaattttccatctccgtttcacagaatgccaaagttaaagagtcactactcagagccatcaaaggaagaaagcaaagtgattagaacaattttaaaggaggacaaaaatcaaaacaagatgcaaacaaggaataataggaataggcagaaaaataaacatacagtgatgtttctttattatgattataaagatgatagatgagtaaaatcgagttacatttaagttgtaatggaagaaaataattgcagccttccatcaggaaaccacaaggaccgttattgatctgtcatcctcagggcatgtctcgtaatatttaataaaataaacaaagatttataacttttataggccatatatctataatctcccacaccacttgaactgtgaatgtggagtcaatgttacaaataacatccatgtgattatactggtttggcatgccttattccaacaatctagcactctcaagagaatgtattttgtattagggatgaaaaatgtgaagccagattatagagttttttacttattgtgctcaaaaatgagaaaatgttatccaatatgaaaaatgttgttaaggattcttcattcttaatattagacagcctttcaaacctaaatattaaatatcttggccatatgccaaatgtaatagctaccaaagcaaaatcttgcaagaaagaaaatccttgaggtataaagattcaatgtactttttaaaaaatgtaagtaaaaggttattaattttacatttcatttctttttctttcctagacactacttcatcctctcataggctcagggagtcactgcttcctaacttctttattttaattatccatgctactcattccacgaaaagtggcatattgcattattttattaaaagaaatttaaaattagtttctttccagaattttgtaacgccccctgagatcactgggcacacccttggggtgttagaaaacatgttacaaaatgaacctttaattccttttgctttttcccttcctcttgctgactgctctttaaaccattacatggctcattcacaagtctctctaccccaggaaagatgaaaaagcaaaggcatgatgtttttataacctaatagcaagagaacacagtgctgaagctgtcaccaaaactgtgggtaggttttacccgtgggttatattaattcatgatatgattgataatatctctcacttgtgtggggaatgaagcgttaactatgccgcatgcattttaaattaatttgacattattcttaatgtcctttcaagcaggtggcattataacctgtgtcttatttaggtagttgatttctacacggagattcatctgataaaactgatatcgcaaacgggaaggagtttgtacaaaatgaaataaatcttaaagttgatttttgtaaagcccaaatgttaattaaaatctttgaatccacaactctgatacatgatattttcattgacataaacatgattagcgatttctggaagcatgtgggatgctgcattgataaggatatgaacctccttgagtaataatgtatatttttactccgaatactgtttcacattttgggtgttacatccttacttcagacttctgccttatcagtggccatcccaccctatgttcttatctcctcagtctaaaaagaaaaatggggacccatcagaatttggatagaagaccctccaggaatttctgccactgcttattcatgggttggcacagacactgattcagtgggcacacagagttcagaatgattcagagcccagatatgtgccctaagtcacatctccagcgtccagggaggactgtaaagtgctcgttatcaggaaaatgaaaccaagggctcagctactcctgaagtcattaaaactccttcccttgatttttttttttttttttttaaatagtatatgtggtaaccgaatctaggatcctggatacattccagtctgctaattacatatttttttctaactaaaatgttccaggcaggttcatttgcatgtgaattacttgctgagccatgttgacttcctattctaaaagcctcactctgccttgggaagcagtttactgcacttcaccctagacctagtctaatgttggagcagacaaagtgtagctacccatatatacttcaaaaatattttccagtctccccacaagaggaaagaaaaatgtctagcaattgcatgctaatttagaccaaagctttgttttaaccattcttggtgatcacaaatggggaaaaatgatttatgaacagtataactataaaacaaacaaaaaaaaaccattgtgaattcagagtgaagtctgacttcatttgtcttatttgggtaaatcagcaaaatgttcatcagtcagaggacattaaaatggtagatgatacttcaaatcgtgccctagataaaaggagagaattaaggttagttttgatttgtaaaccattctcttcgaaggctgattttataaaaattaagtttgctgagtcatcatctcaaaatatatagttattcatgattagttaaaatttgtgtctgtgtatcaaagaagtaaatttgtatgatattaaattttctaacaatgttttaaattttaaaatgtccgattaacacttgcatctagcaaccagtctactaactaaactataggtgaagtcatgctcaggaaatggggaaaatgcacagattaaattggtctgttagctctgagtgaatcaatagtatttagtgctaatgcactaaggagattacaagcactaatgcagtagcagtcaatagcgaaaactaatatctctaaaaaatatcttgacaataaaatgtgcaatattttccatttatcttaagctaattacattacctgcttgttctttcatcttattagtttaagccaagtgctagaagcctaaccattttatttagtgcataaaagggccaaaaccttgtaatcattgttttcagcaggagacagaggaaaggattaattcatgtaaccaagattcaaccagaaattcaacagatatttatttagtctctaaacctgatagtattacaatggagaatgagctagactgtacctgtcttcaacaagcagatagactagtgaagatgacagtaaacattcagtcacaccagtgaacaaatacatcatgataatttatgaaatgtgctgtgagggaaataaacatctgtgaatgcaaatgagagggaatatctaaatttggtagttgagtcacaaaaggctgtcctgaggaggtgaaagctaacctttatataaagcttaaaactttaaaaaagcaatacgtctttagtacacaggcaaatatataaactaaatatataaactaatagtcattacttatttcacaagctttacatcttaactacaagctgctacattaaatcagctttcttaagtggtttgtggtcattagtgcatactatcttacacttagaaaaacattgcaagaagtagtacaatgctggagaatttaactttttaaaacatttcctgccttaaaataaacagcagtaaatgtgtttaaacattcttttgatttctaaatgaattaagttactttttattatgtggttcttcttcatatgaagaaaataatatgtagattactagaagctaagaacatactttagatcctgctcacactcactgcctttcctggcctgtcaccttaatcagcttctttgaaaatcactgtttcttacataggccaggttgtttcttccttgtttccctcttcttccttctatggccaacccttgggaccccgtttgtcagaagaacatgttcctctttggggaggaggggattgtccttttaccaataagttttatgaccaagagaaacataagaatctgagaacacacaaaataagctcttttgaaactatcaaaattataaacattaatagaattcaagggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaattaggtgatcctggggcttaaggaactgaattaaatgaataaagaagaggaatttctaatagggcataatctaactgataatttgttaaatgtaaacttatttgtggctccaacatcatggtaaacaagaatgaataaatgtattagtaagagtaattgagaagtatttctaatgtgaaaaacaccaattacattgggtttatctggcgccaatgtggaaataaatgagcaatatttcttactctcaactaaacttactctcactttcagaactgttataggaaaggtattgattcaagtagagttgggcatgcaaagcacaagatcaattctgttactggcctgatattaaggatattagtcagtgtttgaaaaaatgatttgtaatatataagtagtagtttaacaaagtaggtaaaacttgtaattaatttcaaaaggtcaaagcagagattattgacatgtacaaagaggacccgctttatatgtgcctgctttgaaaagtaataccgtagtatggtaaattgtgactaattctgagattttctgtctagattctttttaaaaccaaatgcttaagaaaaaaacatgagacatgagtagcaattacattttttaggctgagtaggtagcataattgcctcatgcctgcctcctgtctccatttgtttttagtagattttgcacagaaaaacatgttgacctcggtactgaaattttggagttcactatttgcggcacagttacagatcacagaaaaaaatgtacaacaggacttcaccacacctaacaaaagaaagttttcttattaaaaaaaaaaccctccaaattattgtgagatctagggtaaccatggtgttaactatatgctatttgatatcttataaccctggtgataagataacaatccaattgaatgcagatgaactcatgaaaaaagaaggattatgaaatatttggaaagtaaacacctaaattttcataagtaaatattaattatttgtgtgatctttagatatgaaagcttcccctgcatgcacttggctcttggaaccagctgttaaaactcccagcaccttagttaataccctgtatgctggtggttcaagaactagttaagaaacagtcacattttctattttcactgccaatgtataataaaatctctgttccagtgaatggctggccaattattttaataacgatgttggcatggcttcattttacctttcttgctattagcaaagctttccttttgtactctgaagtacgggtaaatcacaaattaaactgagctgttgtttgtttaatgctgtgtttcctgctaaccttattcttgtctatcaacctgaacgtagttccccagtggctcagaaaaccctcaattgggattaagtaatagtttacacaaccttgctcagtcattaacctgtgttgactttctcattcttgtgttccagcctcatttaagagtttcttaagcactctatccagttgctggtttggtgacaactaacaatacctatttaatcaagaaatttaatatttccaaggaatcatttatcgtatctcagacttcttcattaacataatctaattcagtcttgtattccttcttcaaaataaagcctggtttcattcatagtaaatatgaagcttaaaaatttttacttcttttcttctctatacacacaaagcagaaagagaaaattgtatattatcattccagacaggtttttttttttgtttagtgtattgacattgatgccaataagataaaactagacctcagtggctcctcctcaactccacccaatctatttgtctccaaagtgctgttggagtaagtaatctttgttaagagcaaacctatttgtatatctgatgataatctgagggataataatatgatatttaaggagtttctgtccttggccctgactatttcctggtcctccttcacgcccagtgatgtgctggtaaatgttaaactctggggggaggggcagcagaagcccctaatttgtagcatttgccaatttctatggtgtaaatatcccactgagccagtttcaaggtaccactgaaacagcgttagtcactgaacaacaatgaggaagagatgtacacacttggctctgtgaactgttatgagatggttcaagcacagcactgccaccctgtcctacacgcaacctgtcattcttgtagttcccagaatccatcagcctccctcacaaccctgccttaacacgtgtagcttggtccacttcagattccctttaacactcattttgtcaagtgaacactttttccctattctttaaaacttccatgctggcattttccttccccaggacatttttccctagccttcaactcatcccctgccccccatattctggatttgttgcgtttcctgagcacaccagtagcactctgcttatttctaccatgtctcttatcacactccgtggtaatgtgtccaacagttccatcgttagccccctgaggggatgaactatgccatttatctccacagtcccagcacctaatacaatagcttgaacaatatatacatttatcggatgagcaaagaagtatgacagagccctgtatgtaaaatatattactataaatagaatgctgattcataaaaataattatttagataaaacagtttttccgtctctcccctaaatccctaaaaactaatttatagaattggggagttttcaagagctaaattagcactggagaaaaactggggagttttactcactattacctatgcccctcccgtcccccccacacacaccctccttcattcaccagtctgcaatgaagattgatcaaagaacaaagaagaagaaaaatgaaagaaaaaggaaagattaagatagggagggtgaatagataggaattccagagttttgtaatcgaaatttggaactcagaattaaagtcattaaaaggagaaagagggaatactttctctgctcccgtaaggttttctcaagcctttcaacagcactcaccctttgagcgggtgataccatctgtaagagggactttacgcaatgctttagtgggcgtggcttgagcagtgacaccagtagagatacccccttgaaactttcatttgaagtccacagattttcactattggtcaccaatccatgatttcaagttgaaaatgatatatgggttaaggaaaagaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggggtaatggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaggaaaagaagttaagggcaaaggtctttatcaacaccatccttcctgtggccacaggatcgtaatcccagtggcaacattcaaaggcaccaagtacgtgcttggtacagagagaagctttcctgagcttggccttggtgtagatgcagtgagaactgagtaagggcctctggcagggaccttggctgctgagaaggggagcccacagatggaggtttctgatcaacaggtcctatcagaaacaaggggagcagataagtaaagagtctcactccacggtggcaagatggaaaggagggataagaggtcatgacagttggattaatggcaggctagaatatagtcatgggcttgaacgatatattgggacacaattgaaggactcttgtttcatccatcgttcatctctcctggccctctgtgaagacatttatcacctgtttctattgaatgtgacactgttaggcacataaacagaccatggctcttaccacctccaagaagaactacttctgttttatttgttagtgcagggtaattggtgttgtgtcttctgaaaatctcttatacttctatgagtaagtgcattgaaattgtttctgttaactaagtagaggaaagcagaaaacctctttgcactaagcattaaaaccttcctaacttggaacaattttctttatgaatcactctgtcactcctggctatgattgaagtgcagtatgaaggctgctaaccaaaaacacatggacacagtctgtttcagatctgattcaccttaggaaatgatgataaagaagcaaaagttttaacacttagaattccaaggtccatatcattgtagaattgattcttttgaattgtggtggtacctcaagagaaaggatttatttatttcatttatatttaaatgcgtttgtatacatatgtatataaacccatatacacatatacataaaatatattctgctccaagtatttatctctcttttctctttactaatccagcttccattaagaactggctcaacttcgacctctgccatgagccttctccagctgtttaagcccacacagatcttatttttttcctagtcttagaggatttactgccagtacagtgttttcagaatgtaactatcaactgagttcttatactttgcatcagttagctattgtacgtgtcaatcttttgtctccctatgtagaggctagacccaaggtagaagcatttgccaggattgacaaacgatagcctgtttttatattctcaacaagtgaaaacttattttgtttatatttttttccctttttatacagttaaacactcacatgcacgcacacacacacacacacacacacacacacacaggccacagggaccctatggccctcaaagactagcatatattctatctagccctttcccaaaaaacatgtgccaacccctgcattagagaatagtgtaaaataatagtggacagataacaggtccacaaattttggagagccatggatgaccttacttatgaacttaagtaattctcttcaataggtgtgagtgtttccattttacagatgatgaaattgaggctcattgatctaaacaattggattttgtcttcataggcattatgagggcttactagaccaacaatagtgataataataactgtttagttgcacaaggcagggatttatgtcttttttatttgctgccatatccttcagcacctagaacagtctgtcacatggtatggtattatattcattttccagagctcccataacaaattaccacaaactgggtggctgaaaacaacagaaatttatcctcacatggttctggaggccagatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttgtagaagtcggcttaaggaagaagattctaaaatcaaaggaatcagattgtaggaggccatgtaggcaatttcctttaattcaatagaagagagtataagaatcagccaggcatggtggctcatgcctgtaatcctaacactttgggaggtcgaggtggaaggattgctagagcctgtgaattcaagaccagcctgggcaacatggcaaaatcccatctctacaaagaaatacaaaaattagccaggtattgtggcacatgcctgtagtcccagctactctggatgctgaggagggaggatctcttgagcccagaagggaagaggttgcagtgagccaagattgtgccactgcactgccgcctgggtgacagagccagagcctttcaagcaagcaagcaagagggaaggagggagagagggagagagagagagagagagagagagagagagagagagagagagagagagagagaaaagaaacggagagagagggagggagggaaggaaggagggaaaaagagagaaagaaagagaaatatgaaagaaagaaagagtaaggaaggaaagaaagaaggaaagaaagaaaaagaaaagaaagaaagagaaagaaagaaagaaagaaagaaagaaagaaagaaagaaagaaagaaagaaagaaagaaagaaagaaagaagatatgaacaataaaggaaagactcaaagatggttcagatctcaaacttacggagagggtagctattgatgcattgagaaataggaagctggaagaggaaatcagtttggagagaaaagtgatggctttgaacatcatcaatggcgtattcaaacatagcttgaaggcatttgcagagacagggctggtcctcggaagagatggcaacggggtgtgtagagttaggtcatcaccacgaggctgtgagggcagagccacagtagcttccatcaccttgtgaatcaccagtgctcagcccgtggctggctggccggatgcctgcttatgctgtgctcccggctgtctggctgcacacacaaccgcagagcatgccctctctggctagggcagaaagaaattgaagcctcttaaattttgccccccccagctttgctcccttgctaggacttccaggccatgactattgaagccatagggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccacagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctataagaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagcaattaagttttcagtcaactgtatgaaaagctctagacaaagaggtactttctatttcaaaatatgtatttcccagaaaaccattaccatatctagctagaatttctacaaagaatgattatgaataaagtatatattcaaatgcttctggtaatttagtcatggtcaaagaggagagaaaggtgatacaagtgaactggcaaagattttacaagatagtacatttttaaaaattttatttgcaagactgatttaaattatctatagatgagctaaatctgtcctatagatcaattaaatgaatcactattttaaatatatcacattcttaattacactgaattaaatataattacatattcactgcatacatcataatgttaattaggggaaacattttgaatcaaatatattgagatatatagcacttcaattttctttttataaaaaaagctatatgactaagtcaggtaaaaagaatctggcaagtactcatagaaagctaaaggaagactagattaattgatgtatcacatcaaggcttacaaattgtagaggaattcctattctttaactctatgacagtatataagactttgggctaaggaagcaagtttgcaacaagtttttaaaaaataataaaacaggaggcagggcacggtggctcacacctgtaatcccagcactttgggaagccgagacaggtggatcacaaggtcaggggttcaagaccaacctggccaaaatggtgaaacccagtctctaataaaaatacaaaaaagttagccagatatggtggcgggcacctgtagtctcagctattcaggaggctgaagcagggaattgcttgaacccaggaggcggaggttgtagtgagccgagatcacgccactgcactccagcctcggcgacagagctagactccatctcaaaataaataaataaataaaaattttaaaaaataaataaaataaataataaaacacattgtttaccattgtttctcagagacatacgattattttagaagtggataagccttttttttttatactttaagttttaggatacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgttcatgtgatctcattgttcaattcccacctatgagtgagaatatgcggtgtttggttttttgttcttgcaatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgtcgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttttttcttgtaaatttgtttgagttcattgtagattctggatattagccctttgtcagatgagtaggttgcaaaaattttctcccattttgtaggttgcctattcactctgatgatagtttcttttgctgtgcagaagctctttagtttaattagatcccatttgtcaattttggcttttgttgccattgcttttggtgttttggacatgaagtccttgcccatgcctatgtcctgaatggtaatacctaggttttcttctagggtttttatggttttaggtctaacgtttaagtctttaatccatcttgaataaatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtagttttttccaattctgtgaagaaagtcattggtagctttatggggatggcattgaatctataaattaccttgggcagtatggccattttcacgatatggattcttcctacccatgagcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaacatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattctctctttttctattgattggaatagtttcagaaggaatggtaccagttcctccttgcacctctgatagaattcggctgtgaatccatctggtcctggactctttttggttggtaaactattgattattgccacaatttcagctcctgttattggtctattcacagattctacttcttcctggtttagtcttgggagagtgtatgtgtcgaggaatttatccatttcttctagattttctagtttatttgcgtagaagtgtttgtagtattctctgatggtagtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttcctcagttctgctctgatttagttatttcttgccttctgctagcttttgaatgtgtttgctcttgcttttctagttcttttaattgtgatgttagggtgtcaattttggaactttcctgctttctcttgtgggcatttagtgctataaatttccctctccacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttctagtttgattgtgctgtggtctgagagatagtttgttataatctctgttctcttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagctcttcctccatccttttattttgagcctatgtgtgtctctgcacgtgagatgggtttcctgaatacagcacactgatgggtcttgactctttatccaatttgccagtctgtgtgttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatatggaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctctcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttcttttcctttggtttgaatgtcctcccgtagctcagagtaatttgatcatctgaagccttcttctctcagctcgccaaagtcattctccatccagctttgttccgttgctggtgaggaactgcgttcctttggaggaggagaggcgctctgcgttttagagtttccagtttttctgttctgtttttttccccatctttgtggttttatctacttttggtctttgatgatggtgatgtacagatgggtttttggtgtggatgtcctttctgtttgttagttttccttctaacagacaggaccctcagctgcaagtctgttggagtaccctgccgtgtgaggtgtcagtgtgcccctgctggggggtgcctcccagttaggctgctcgggggtcaggggtcagggacccacttgaggaggcagtctgcccattctcagatctccagctgcatgctgggagaaccactgctctcttcaaagctgtcagacagggacatttaagtctgcagaggttactgctgtctttttgtttgtctgtgccctgccccgagaggtggagcctacagaggcaggcaggcctccttgagctctggtgggctccacccagttctagcttccaggctgctttgtttacctaagcaagcctgggcaatggcgggtgcccctcccccagcctcgctgccgccttgcggtttgatctcagactgctgtgctagcaatcagcgggactccgtgggcgtaggaccctccgagccaggtgagggatataatctcgtggtgcgccgttttttaagccggtccgaaaagcgcaatattcgggtgggagtgacccgattttccaggtgcgtctgtcacccctttctttgatccctgaccccttgtgcttcccaagtgaggcaatgcctcgccctgcttcggctcgcgcacggtgcacgcacccactgacctgcgcccactgtctggcactccctagtgagatgaacccagtacctcagatggaaatgcagaaatcacccgtcttctgcgtcgctcacgctgggagctgtagaccggagctgttcctattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattccatgaattaatatttgtaaaatgcttagaactgtgtctaacacattgtaaacactaggaacaaatgctaaggtcatgcaactcatcaatgcctccctggggtagaaccagccttggcccatgggcatgctcattcttcttttagacaaggctcttaggcatccctagagtgtgggttggccttcctatgcctgtacgtaagaagtatgatgtaatgtaaggaatataggattcaaaatcaacaattaggattcaaatgctaatatttattgactcaactctctgaatcttagtttcttcatctgtaaaattataatgatcataacaaacccaagtcacagacttgttcagaggagcaaatgagataatgtactttgaaaaccataatctactctgcaaatgttatgtaacattataattgtgagttcagcaaagccatgagaatgtttcaaaactgtttaggacatcaagaagttggggtggggaaaattcttaataggttttctccatatcctcattttccatttattcattgttttaaaatttatttttcttatgatatacatatatatatatatatatatacacacacacaaaagaattatgtacggtcctgcattgcttgcattctgagaaatgcatgaataggcaattttgtcattgtacaaacatcatagagtgtacttatactaacctaggtgatatagcctactacacacctaggctgtatggtatgaccttttgctcctaggcaacaaacctgtacagcatgttactctgctgaatactgtaggcaattgtaacacaatggtaagtatttgtgtatctaaatatatctaaagatataaatatgtctttataagtatacaaatatatctttaaatatactagtatatatttatagatacaaatgtataaatatatctatagatgtactagtatatatatttatagactagaaaaggcacagtacaaatatgatattattagcggggtgtggtaattcatgcctgtaatcccagcactttgggaggctaaggtgggagaattgcttgagccctggagtttgaggttacagtgagctacgaacacatcactgcactccagcatgggtgacagggggataccctgtctctcaaaaaagaaactaaaacaataagatagaatcttatgggaccaccataatatattcagtctatcactgattgaaatgtcattatgcagcacatgactatatatatgtatatatatatatatatatatatatatatatatatgggatataaaacaaatactcatatctctaccaccaggctcaaaaagggaatattacctttgaagtcccctgaatatcccatcctagcaatattcctccccctcctggaaaagtgggtaaacaacaattgtaagtcatgtgtttgtctttcctttgcctgtagttgcgctacacaggtgtgtgcccagaaaatattctttattggatgcatggggtttccttcttgactcagagatctcaagctatacggtatcttcctgcagccttatagtgtccaccttattctttgtcactatttccctttcccagccaataaagcacattacctctgtcattcaaatgaactcgtaaagagagattttagaaaagagctggttcacctcaggttcacctgagcaaggaatgggtgtcagtgactgtggaaagtggagcacagctgccagagcagtgcaaggacccaagaaatgggagggtcttgactcgggataaccactctgagattcattggatgtcctagattgtcaccttgccttacaccttaagggagaaaaggataaaaagataaggcagatgtgaaagctatactaaggagcttagacttttcctgcaggcctttgggaagcaactgaagctttgaagaagggaatgacagcttgagactgcttcaaggcagaagagataggagaccagaaggccagtgaggaagcacttaggctgggccaggggtacaggtgtggctggaagggctgcccagaagcaccactgtggaccaggctgagcaggactgagtgactggttagatataggaaatgccagagaaagagaaggtggtgatgactgaaatttcagagttacctaaatgcaagcatggtatgttcataaccaaaataggtagcaaggagagctaggtttgagagccaagctgattagtacagaatgcgagtggttatctctgctgtttccagaaaataaagattaatttcagccttaaagtcagggacttaaatgagatgatctcgaaagccctttccatttttgtaattgtgcaatcctcagaacgttgcccagaatagtaagcagaagcaaaagaaattcaggagtttgaacataagagagagctgttctctgatgcctgctccaatgggaactgggcactgtgactgagccctcggctcactgagtctcctcctgaggagtgtgataaaacctcacagggctgctgtgggtcttattatacatgaaaatacccacctcagtgcctggcacattctgggtgcaggaaaaagtttgatttcctccctcccttccttccttccttcctttttcctccctttgttaccataggagagagtcaggctggttccctgcgggtgctggtgtgaaacctgctctttagactcttctgcagttccccaaagcagctactgtcccagagaactgctttctgccagcaatgctcagttttaccctaagacacgataactcctggctttgagggaagcacaggtagcaaggggacccctgacagcaaatgtgtagttgttcttccagctaggccccagccccaccttaaatgccacatccaggcactgtgtctacagtgctgagataaagcaaccccgtcttttccacacaaatgagcagcaaacatatttgctgattatctttgagggacataatgaatcagactgagatttagtcatatttgcacaatgctttacatctgagatactgaaagcttaatccaaggtttccctgttagttgaagtcctactgttagggctcaaagacagggtgcagctctgtaagccagtccctgatgccttgatcccaatcattgagtttatcaggattctccataggaagacacaaggagcacctctgctgcagcaaatgctggagtgttagtttttcctagaggctagtgcctcaacacctcttctgcagatctcagctatggagaaaatgaaaaagaaaaaggttagagtctcctggcttatgaaatttgaatgccacttgaacctgacatatttattttttagctctaaatcacacaagatcaagaagttctgcagatcctattccaacattgtgcaatgtctctatatttacaaattttatttgatggggggggcaatagagacataatttaatcctattagttcttgaggagatactatttagagatctcactaattcctgtcctgaaggagaagacttgaagtgtgcaatataaatattgcattaactctaatacagagttctacatttacgccttacatgtgtgcaaacaggtgcacagaggctaaagttctggttgtattgctctccctccatttacaaaagatcagtgagttcctgcttgcagattctctgaggagacccttagtttcatctcctcttcattcttctgctggcctgattcagcaagaccaaccacaaagcaaactgagtaggcaaatgggctttatctctggtgactttgcagatgcactaatttttcagcaggctgtcattaaatgcctactgggtgctaggcataatacagggtcctggggataaaagatgataagacaattcctgtcctcttgttgatagaaggcaggtagtttgtggtcaaagactctcattcacacccaccagattgtttttatatcccagtgaatccattatgtctctggcagcaccacacaccaggtcaagtttgaggctttaaagttcccaggatgtcacctagacttagagatgaagaaacactaacaaaagaagaaacaagacaaccacaaaaacctgagcctgaagagctgccacctctataatggaatatttcaaatggccttagatttaaaattggtctttgctcctttaagcagattcccttagctctggctatctctgcaaaatggatgattgatcaccaatagaaacttaattatcaattaatcggttgctatcgaattgctggtacatctcagttatctgctactcctcagagtaatccatagtactttagtgaagaaatacttctaattaaacagggaaatagcacttgctaatatatcaaagtaaatgactagacctaaaacattagtattaattacaagagtcagtgggtttagcatctctaagtttctatttgctaatttattgccactgaaaatgaagaaatcgttgttgatatataaaatagagcattttaggtggtttttaatcataaaagtcagtagatgtaaaaactctggattgcatgtggcagacatttgaccttaaggaataaggtcgctatacagaaggataactaaacttttatttgtttgttcttaaacaataaaatgatttgaaatatactttgatcattttgtgattattatcatatgggatgataatagagaatttcttacttcctaatcattttcctacacttatagttacatacaaagatgtaatgaaatttgctctccttttcttccaaggtatacatcattttccttaatactttctcccgtccccatcgtctaccccagatttaccaattcccagctatctccttaggacagtcaagaaccaaatactcccatttgtcccttataaactcttttaacttccccaatttctggaaaaacaaaaagctttaataatatagttttatatctccatactcatcccccatctacttataattgattcacttgttcattcattcaattaatatttactaaacatctactatgcatgatagttaatcaactactggcaataccatggtgaacgagtagggtccctgatcgcagcgagctgcttgggagaagtttcacattatcttataaatcacgcaagcaaatgttatgttgcagcttgtaactatgttacagctatgctatgggtacacaggtaaatgatattatgagaatctacactagaagcatttgacttagatagtggggtcagggcaggcctcctgaagaaatggtgataagctaagatctgaaggagatgtaggagttaacaaggtgaatgaaggtggaaggagcatttcaagccgggaaatagcatctgcagaggcccttaatgggagaacacgtgacatatttggagcgctgaaagaaggcctgctcgctggagcactaagaacacagatctggagaagttgggcaggggccggatgatgggaagggagccatacagtccatgttaaaaaaatgttgttctttatcctaacagcaatggggaagcattgagtgttttaaatagagagggatatggtcagatttgtgtttgaaaaagaaaatcctgctgcagtgtgaagaacagatcacctggcaagggtaacagtggatgtggtgggtctagttaagaagccgccgcagtagtccaggaaggaatgaggtggctaggatgaaaattgggaggaagggcatgaaggagaagactggatgggtctaggaggcatttagaaatgaaattgttgggaattggtgatggactgtatatgggggcggagggagagggaggaattggagatgacacttagatttctgacttgtgcacctggaggaatggtagagccattcactgaggtgtgtagtgtcctaaggtcaggcaggaggaagattgtggtttctaggatgggcatgttgttgaatctgaggtctctgagacatgtgaatggagatacttgagtgatgttatctacaagtgctgggctctttgtttgtttgttttgtttttattgcgtgggaggtcttccagaaaacctgctagacaaattctaaaagaaatataacactcatgctgggttctattgtgagagatttatataaactagcttgtttaatagttacacaagctctataaggtaagtactatttttttagttctctctactttacagattagggggaataaaacacagaaattacatgattttctgaatacagaaagattattacataaagcaagtaagcattaggggccaggatttgatgccagcacttgggtcagtgctctgtggcctcccagtgagttatccgttaaccaccactccctaccatctctctgcacaagaatgcacaaaggcacacatttaaaaatataatgtcagaacatgcctctaacatttattattattccagttgaaattcatctcatcagacttgcctgctagaagcattacctttgtgtcaagggctgagacatttaaaagttttgtttttcttataatagcagcagctaagttccatttttaggcgtgcacatattgaaccatggtgtgaattgcgatagtaaggttttagagtctataaataatgcctagtgaaattggagccattcagtccctagaaatatttatgcctatctgtggctatttgtctatttgcatgattatccttgccattatcctccaggctctgaaaatacacactgaaaggtttcttaccagcttgttcatgtctggattcacattaactctatgaccatattttattccagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggtaagtgctttctgagagtagctgtgtctgttctatctggtattgtgcaattaatttgttttcgtttttgcagtaaggtatttgcaaatactgtaaagtccaaatcatagtagaaactggaacacagactgaaagccaaacaatgaagcctggtctactttctgttaaatgtgtggtctctttttattaagttcttgaagctttcagtttgaatctgtttgctttaattttctcgtccagaatggtgtggcattttttttccatttataatttctgtcacgtgattggaaaataaaatgaaacaaagcacttctaggcaatttttttttatttcaagggaagctacagatcaaaggagagctattgtgtgaaccatgcatcttcatgagaagaaacattcacatcattgagaaatattggcaggagttaggaagggacaacattatcatcaaaatcccattgtaactcaagctctcctgattctgtaaaatggtagggttggatgcaaataagttcagatacaaaaaaaatccagattttattaagaaatggttttaatggatagcaacagtatttctgtacaacaaaagtttccatttcaacttactgtgtttcctagatacaagaaccatagcactttgcagaaattaaaagactctcttgttgggttggtttttgctgttttgtagttattggtgcctttaacatgagttgttagtagattcttgatgaggaaagaatgacaatagcatctatggaaatcttgaacttctgtgaatactagaaatttcttttaaagggagatttcgtaattgtctgatgtagttagtaccctcatcagacaataacctctagtaaaccaactgagaatgataagcttttcctataacttgcctgtctatacatcctatatgtgtattcttctacaaaacatttttttaattaccactctctttatagcagcctggatattgatcattgccatattttaaaacctgtaagttatgtttttcttgtactaaagggcatggtggaattttttcaaggtcaaaaaccatgtaaataaaaccttcctagctcaaaactaatcatacaggtcctgttatctaattattcccctagtaatctcccttctattgcttcacattgaactacgccttttctccccctttcctctgtccattccactgtgcttgtttatccaactcatccatcttgaccatttaattctatccttaacttctcaaacctgaaggagggaagccccgcccctcccacagagacatgcactctaatggatttgaaatatgctcatatctattatgtgtaaaatgtgtagtattgttctgtgtttatacatgtttttaatttacatcaatggcattctatacaattgcaaaaatacaaagaaggactagaaaagctggcatctattgatttcctaatgtgttcattatgttgatttgcccccttttatctttatttctgcttttttttttttcaaaatcgtccattacctcaccaatccagttttgtatgaataagctttttatgattactttagctccgactttttttaacatcaaaagttccctggcctatttccacattctaaagttgtaatacaattccttatttaaatatgttgctttattaactgagtaaattctgctgtgtgacagagtcaatcgcctgagggatatgtcacgcatcagtctcattatagaaacgctgtagcaaatgttttattcttgtctcctagcctttgtgtaaaagaaactatattttgcctattaactatgcatccaaaacaaaaggtaaaaaaaatgcttattttatgaaaagtactggtatcactgattttttttaaaagtggcttttaatttatcaaataagtatcaagaactacctaactttgctttactatacaaacgaatgaagcaaaggaaacagtgacacagaacttacctttaagaaattaaattttagtaggaaagatacctgataataatagtacctacagacaaagggctattcgaaaccacagagaatctatttctctgacgcttgcctaagagaatttcattccattaaattttataaagaaacctaaagcatttgaaggatcaaacaatcaacatcactgaagtccatatatttacagtaaataatagtgcgggaggagtcaggagtggagcacagatatggcaacctcccactttaatctgtcagagcagtgacttcctacaaagttctgtaaatgttttgactgcaccacagtgttaaatgtatggctaggcctgagtttctacaactcgtgttttagtaaatacgatgaagtttctgttacaaaatagaatggacattttttttccccccaaagacagctgccctacacaaaagggaacagaaagatgattttacttccttcctaccctgaagcctaatggcaaagttgctttgcaaatttttttctcccaagagtttgcagctgtttctgtctttcctattgtgcttatgttcagctctggctgggaacacaagctacagccccagctgttgggtgcaaagtgaatcaggtatttcacagtggtcatttgattagaaagaattatattgtttagctaacaacattttgtgtatggcagggaagacatttttgacatgttcctaacatttaatgatgtgtaacttatcttgtacaggtgcagctatatctgaaaatactgatgcatacatatatttaagtctcaatatctgcagagccatgtcaatgtagatgaagatttaaaaataatttttatttgcatgatcactctcttgggatacttcgaagtaaaatagtaggataagcaatgtttgagatagtgtaagtgaacaatgagaacgtgccttcttacagactggggaaggagatgtagaacagagtcagacttgggaacattaacacagtgtacacagctacgtgggagagggaagagggattctcatgaagatcacaggactaatcacagggattgtccacgtctcccttctgagcgcctcgtctaatctacatccagaacaatgcttccttgattttttttaacagcacttgtataaggcttttaatctctaaatgcaaagcattgctattaaaatatttgtgcatgactgtcaggccagggagagtgagtggatcagggatgcgagagggggtggggaggccctttcaagaattgtttcaagttcagctccacaaatactcactgggcaactactatgtgcactacactgtgcctgctcccaatggccacagcctgggcactgtcactgctgctactgggctccgtggttccatcctagctcttcccgcatgcccctttcgcctctccaagttcctaaatgttgttaccacccactcatcactcctgttctcttctgcctcttaactggactagttggatcttaagtaagaaacccaaggaggtagagatcacctaaaaagatgtcccatgttcaagatcattacttatgaccactacttaaaggactgtgttagtaatcagtgaacctaagaataattactcacttccaataagaaaaatttgtttatctgttgacctcctgtcttcaaattccttcagttcccgtgcccccatcgtggcatgtcagtgctttctgtgagaagcctgtagtatgcatcatgtttggaattactgccattttagagtatgtagatgcagatccccaattcgtcaatgttgtgaacatctggcagagacacagctgaaggaagcttcaacttgaacaatgattctctttagggatttctaacttacccatctcttttataaaataatcagataaaaatattatctgcctttttgtgtgtgtacatcattaacttagttttaaccctaaagaatgttagctttggctttttttttttttttttcacagtgtctcgctctgttgcccaggctggagtgcagtggtgcaatcttggctcactgtaacccccacctccagtattcaagcaattcttgtgccttagcctcctgagtagctgggattacaggcacgtaccaccatgcccagctaatttttgtacttttagtagagacgggtttttcgccatgttggccaggctggtctagaaatcctggcctcaagtgatctgcccgccttggcctcccaaagtgctgggattacaggtatgagtcaccgtgcccacaagatttggtatatttctttagaggaaaatacactcaagggttctgaaatttcttttgtgtaagaaagaactttttataaataataatttcagttatgtccataactaaaaatcaaggattccatttatatgaaatatctagaataggaaaacctatagagatagaaagtagattagtggtagtcaagggctaagaggatatggggagactgggaatgacagctaagggatgtggggcttctttttgagataatgaaagcattctacaaccctgtctcaaaaaaaaaaaaaattaaaaccgttcaattgtccactttaaaaacaatgggggaggtatacagaaactgcatacaaacatcttatcttaaattgtattcatcattcttaaaatttaattctattaataaaacggtttaattaaagataaaactgtatatgggaggtaaggagatatggcctttacatatttgtggatatctcacacaaagttactttgttcaggtttacagatttgggggcctagccacaacagttttatttgtacatgtatttcttccccatgtcctatctacaaggggctatgtgagatcaaaaccacaaccatttggtaaattcagattctgccctgccccaaatgtattagtcctgtattttcaaggccattaaagaaaaaatatcctgtgacctaattactaaagattagttgttgaatagtaggaactcaaagataattgttggtcttctattttatgcgaattcttctaagattcccaggttatttatcataagaattacatttacatggcaaatttagttctgttcctagaaatatctccatgacaaccaaaaggaactcctaatttctggcacacattacttcaggggtattttgagagttaaagtggttaatcgattatttagaatcctagcaataagagaaagaaaagaattaagggtagaaaaacatttatagcagtaggtatccctgcagagaacgggctaatgatcaactaaaaaggcatttgcatctgtggtacagcctctgcgcaaaattccaaatggcattctcacttccaagtcacctcacttctccatgtgccttcctgtcttctcatcttcatcccattttctatagcaagcaacactcatgctaactcgtgatcaaaagtagagcttggcggagtgtgctagtaacattttctctatgccctcaaaaactagttagatgcagagactttctccttaggcacacttaacttgtgcagcaaaaattactgaaacacggagtaactggcgaggcaaatatattgtgaaatttgttttagtacttttactcacgagtggctcttgggagctcagagttgaagctttttcaatggtatttactctggtgctccaagagcctagcagttgagtgtttaagaggtcaagcacatggattctggcctcagataaagctctgtggaaatctgactcatgtactttctagctgaaattctatgttgtattttttttaaggaaaataatagtacctaccttataggagtattgtgaggagtaaataaaatctccatttaaagcacttggcacaatatgtgactcagtttcctgttatgaaagtacaaacatttggtgcttttcagacaaagctttttaacagaggatacacatatcaatcaatccaagtccagaggtgcaaagagcttccgaaaagaaagagaaaggttaattctttctgggaaaggactatttggatgggcttcagatatttcataaagtcaaagatgatgacctagtaattaagaagggattgcttattatagatttgggaaatggtattaaaaagagcaagaaggtaggagaaaaaaagggctctaggaggtgattgttatgtagccggtctaagtagaacggaggaaaccagggagacagacacaaaatgcaggtgtccattgcaaggttcatagtgatgaataatcttcagtgaagtgcaaagcatagaatgagctggaaaacaaagtcagggtattaagacagactggtgttctgtgttgcttttgacctgtgtgtgagaaaaggagtttttttgcttttgtgtttttgtttttgttttgttttttgttttacctttgcagtttgaagtgattggcaacagccaaagaaatatggggggtattgggcaggagtataggaaaaatgagatgtgatgagcccagaagggagttaagattgcaaaattgggtaaccaaaatctggagaatttgtaatagaagctttagaagtctaacatctgatattctgcttgtaaccagtacccaaagggaggtgggactggtaattgaatttctgttcactttgcctgcaaaggtcaccaatacctattgggccctaactttaggaaataacaatagtttccaacctttcccatcctgaccaagtgacccttcatccatcacttaacttctgtgcaaatataaccaccctttttaatggagatgttttgaaagcgttgagtgtttagagtagaacaaacattagagcacaaatgtcatgatgtttaacttttacagctgtatgtgagcttggttagtttctctatcaacaatccactctctgagaacaaattaggtactttgagaatcttcccaaattgcttcaggatacttggctcctttgttatgctgaagaaaaaatttacaattgttccccagaacatttatatgttgtatgtgtttgttagagtacaaagcagttaattattgctgtaattttcattcccattatacgaatgagaaagctgaggtagagggagtgactatgtaatcgtaatctcacagatgtccatgtttgtcctgtgatttcatacccatcgcgagtaaatgcatgttcaatgcaatgtaaaaggctattagagatgttgggcaatttcacaaagtagatttcaagtctagggctgtgctgagcctcctccaccttcatgtatatgcaacccagtggcctacttaagagtgaaagtttctctgagaactccaacaccctcctaaaaatctaagtgttcatgtaagataatcatttggattttatcccaattgttgtcaattatgctctgaactttattattactgggttctaggaacaggacagatggaaattagatagctgggaaacatcccaaattttaaaaacctgaaagcaaaaatgacatcaatcatcaaacctcatttcccgggcattgttaaaaccatcaggccttattttaaagccagaccaagaagcagagttttataatccaagtaataatatattgtgggacagtggtttataaaaaaatacaacacatcatttcaaagtagctgggggcctgttttgacctgaaaagatctataaatgtggcttaagagtagcacagctggaactagctccagtattccagactccgcgtccactactcttaaccattacatcaagggaaactgcctggcagggaggattaagaggatatatttaaaaaataatccagattcattgtagcatgtgtggtgtcttctttctggagagagttttggttcctccattttccaatacaattgcagggatttgtctgtatgtgctgccaattgattgaaagatctctttcccttgaaaccattaaaagatcataggcaaagtctgtcttgggggttcagataatttggcttcaaggcaagagattagaagatgacatattgatttacaatgaggggaactgttgggtcttcagttcaaacacccacaagccctgctaatctgttattaccattatcatctacattttccacttatatttaaactgagcttgttggaataaggatgttataacttttttgctgtttaggttgtggtttctcgatcaggaccatcaacccctcatgtgaattttctcctggactcccatccagtgtctccagaagtgattgtggagcatacattaaaccaaaatggctacacactggttatcactgggaagaaggtaagctgttcccacagggaatttccatagacgtggtttttcccaaatgcatatttacaaccagtgtcacttggccctttataatgtctctcttcatcttaaatttacccctcctccattaagttctttagtgagtattccagagatcttctgaaatctagttaatttgttctccaagaaagactagacctaagggaggtctttttcaaaacttctccttttgtcctatatttctcaacaagaaaaataaacacacagaatgagaattacagtcctaatgacagagctctagtgcaggcagataaatcctggaaatgtacattggaatccgactccaaccaataatcccttttctcctagagaagaaagtgcatcttgatgccagaatgacatgcaactttacttagaattttccagagattcaagtgtgttttcccaccacttaaattatactctcttgttattttaaaatcatctcagacagggcacaatgtccctactatgtagaacctctaacattgtgtggcaatgctatgctcactggacaataatgttactttttcacatacctgctaacaataaaggaaaggaaggaatcagatttttaaaattttaatcaccgttatgacaggatttgcacacatagttgctaagtctagaaaattccatcaaatgatatttacatgtaccttttgtgtacttactttataattaattaacaaactagatacccctctggaagctctttccaccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttagctgtgagtcatcagctaaagcaccatctctctcttggctttatccctcgggcagggagggggtggtgtttgggcatccccccaagtcctgcacctgaagtgcttgcttcacattgtctaggttctatcgctgggcagctgctcacctttagtgccgtgtgaataaaagagtggtggtgaataagcaacagtgctccccattttctcacactggggcctgttccctcctgactcacccactctctgattcctcgccacttcctatataggccaagtgcccagacatgagcctccatcacagaaacagatctgttcatggcatatcctggaaccctgagctgaatcctgcaaactggtgatccctgccatgctggggcacacaggacagttttcttcctgtccgatgcatagatggtggccttgtctgttcacagatgagactgaagattatttcccggggtgaggtgggcaaggcaagtggagggtcaacacccatgggtggctgtgagtcttccttcagtgttcccagaaaaaaaagcaaaggctcaacggatgactatactaacatctatacttctgtaagccatgccactctttaattcattccaaaaatatttattgagtgcataccatttagcaggctgccctctagtccctgaggagatatagtccagaacaagatgagcacatctcttgctgatagagaactcagtttctggcaatggacattggctctaacatcgcagccatgctaactgtgttgccttatttgcttaagcatatattcggcactatgaaaatctccacgcaatttttaaaaatttcttagtccaaaacatcttgcttaaaaacacttccctggtgagaacccagtgtgtatttttctctgtgtgcatgtagaaaagttggactttagtaaatagttcttatgaaagattcaagttaaaggtctcggtcacctggttcatgcccaagtaaacaaaatgtgcgagtcagaacaagaaccacccccaagtgcatggctgttttcatttagttacggtttggagcaagatttgtagtgggtgactgggttttaaaccaagttattttctgttaggtgtgacacagttattaagacttagcttgattgaccagagaataaactaaagacagtgacaaaacaaatttaaatctatactgtagtatttgtgtacttttttgttgttcagtatacttttggaaccgtatgcaattttatacttttataaacaaacaacttcagcaatttgagacactaggaatctgaactctgctattccatgaaatagatatggaaaatatatgtgtgtgtgcccatgcaattaaatcacaacaatttcatttcaaaaataaccaagctggtattttaagtaaagaaaatggtttgataacctgtacaaatgaaacatttaatttttactaatgtgcttccttttactaagcataaaagctatactaaaatgcttaaaaataaagtaaatatttcagaattttctggaaccagagaatctcttgcaatatttaaatgtccctcctctctcacccttcttaactctagcattctatagttgatgattctcaaaggttgcgtgctaccatgcacaagtcagtgaggcttaagctgcagttaggaaggcagggcagctgagtccataaatccctctaggttcatagttgttaggaagatttcatgctgcaccagactgtgacagttagcattcttcctgcaaaacataagacagactcgaggtgggtgttaagatggccgagtaggaacagctccggtctgcagctcgcagcaagatcagtgcagaaggcaggtgatttctgcatgtccaacagaggtacacggctcatctcattgggactggttagacagtgggtgcagcccacagaggttgagctgaagcaaggtgggatgttgcctcacctgggaagggcaagggattggggaactccctcccctagcaaaaggaatccttgagggactgtgttgtgaggaacaatgcattccggcccagatactacacttccctatggttttggcaactaacagaccaggagattccctcatttgcctacaccaccaggaccctgggtttgaagcacaaaactgggcggccatttgggcagacaccgagcaggagttttttttcataccccagtggtgcctggaatgccagcaagacagaaccattcactcccctggaaagggggctgaagccagggagccaagtggtctagctcagtggatcccacccctacagaacccagcaagctaagatgcactggcttcaaattctcactgccagcacagcagtctgaagttgacctgggatgctggagcttggtgcagggaggggtgtccaccattactgaggcttgaataggctattttcccctcacactgtaaagggtacagcttcagcagacttaaacattcctgcctgctggctctgaagagagcagcaaatcccccagcacagtgctctagctctgctaagggacagattgcctcttcaagtgggcccctgacccctgtgcctcctgactgggagacacctcccagcaggggtcgacagacacctcacacaggagagctctggctggcatctggtgggtgcccctctaggatgaagcttccagaggaaggaataggcagcaatctttgctgttctacagcctctgctagtgataccctggcaaacagggtctggagtggacctccagcaaactccagaagacctgcagcagtgaggcctgactgttagaagaaaaactaacaaacagaaagcaatagcattaacataaacaaaaagaacgtccacacaaaaaccctattcaaaggtcaccaacatcaaagaccaaaggttgataaatccatgaagatgaggaaaaaccagcgcagaaaggctgaaaattccaaaaaccagaacacctcttctcctccaaaggatcacaactccttgccagcaaggaaacagaattggacagagaatgagtttaacaaattgacagcagcaggcctcagaatttgggtaataacaaactcctccaagctaaaggagcatgttctaacccaatgcaaggaagctaagaaccttgaaaaaaaagctagaggaattgctaactagaataaccgtttagagaaaaacataaatgacctgatggagctgaaaaacacagcatgagaacttcatgaagcatacacaagtatcaatagccaaatcaatcaagtggaagaaagaatgtcagagattgaatatcaacttaatgaaataaagtgtggagacaagattagagaaaaaagaatgaaaaggaatgaacaaaacctccaagaaatatgcgactatgtgaaaagaccaaacctacatttgattggtgtacctgaaagttacagggagaatggaaccaagttggaaaacactcttcagaatattatccaggagaacttccccaacctagcaagacagcccaacattcaaattcaggaaatacagagaacaccacaaagatactcctctagaagagcaacaccaagacacataatagtcagattcaccaaggttgcaatgaaggaaaaaatgttaagggcagccggagagaaaagtcgggttacccacaaagggaagcccatcagactaacagtggatctctctgcagaaaccctacaagacagacacaagacagggatgccctctctcaccactcctattcaacatagtgttggaatttctggccaggacaaacaggcaggagaaagaaataaagggtattcaattaggaaaagaggaagtcaaattgtccctgtttgcagatgacatgattgtatatttagaaaactccatcgtctcagcccaaagtctccttaagctgataagcaactttagcaaagtctcaggatacaaattcaatgtgcaaaaatcacaagcatttttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatggataggaagaatcaatatcatgaaaatggccatactgcccaaggtaatttatagattcaatgccatccccatcaagctaccaatgactttcttcacagaattggaaaaaactactttaacgttcatatggacccaaaaaagagcctgcattgtcaagtcaatactaagccaaaagaacaaagctggaggcatcatgctacctgacttcaaactatactacaaggctacagtaaccaaaacagcatggtactggcaccaaaacagagatatagatcaatggaacagaacagagccctcagaaataataccacacatctacaactatctgatctttgacaaacctgacaaaaacaaggtatggggaaaggattctctatttaacaaatggtgctgggaaaactggctagccatatggagaaagctgaaactggatcccttccttacaccttatacaaaaatttattcaagatggattaaagatgtaaatgttagacctaaaactataaaaaccttagaagaaaacctaggcaataccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaaccaatttacaagaaaaatctaacaaccccatcaacaagtaggcaaaggatatgaacagacacttctcaaaagaagacatttatgcagtcaaaagacacatgaaaaaatgctcattatcactggccatcagagaaatgcaaatcaaaaccgcaatgagataccatctcacaccagttagaatggcaatcattaaaaagtcaggaaacaatatgtgctggagaggatgtggagaaataggaacacttttacactgttgatgggactgtaaactagttcaaccattgtggaagacagtgtggtgattccttagggatctagaactagaaataccatttgacccagctgtcccattactgggtatatacccaaaggattataaagcatgctgctgtaaagacacatgcacatgtatgtttattgcagcactattcagaatagcaaagacttggaaccaacccaaatgtccaacaatgatagactggattaagaaaatgtggcacatatatgccatggaatactatgcagccataaaaaaggatgagttcatgtcctttgtagggacatggatgaagctggaaaccatcattctgagcaaactatcgcaagaacaaaaaaccaaacaccgcatgttctcactcataggtgggaattgaacaatgagaacacgtggacacaggaaggggaatatcacacaccggggcctgttgtggggtcgggggaggggggagagttagcattaggagatatacctaagtaaatgacaagttaatgggtgcagcacaccaacatgcacatgtatacatatgtaacaaacccgcacattgtgcacatgtaccctagaacttaaagtataataaaaaatatatataaaaaaagaaaccctacaagccagaagacagtgggggccaatattcaacattcttaaagaaaataatttccttcccagaatttcatatccagccaaactaagcttcataagtgaaggagaaataaaatcctttacagtcaagcaaatgctgagagattttgtcaccatcaggcctgtcttacaagagctcctgaaggaagcacaaaatatagaaaggaaaaaccggtaccacctactgcagaaacataccaaattgtaaagaccattgacactgtgaagaaactacatcaaccaatgggcaaaataaccagctaggatcaaattcacacataacactattaaccttaaatgtaaataggctaaatgccccaattaaaagacacagactggcaaattggataaagagtcaagacccattggtgtgctgtattcaggagacccatctcacgtgcaaagacacacataggctcaaaataaaggggcggaggaagatttaccaagcaaatggaaagcaaaaaaagcaggggttgcaatcctagtctctgataaaacagacttcaaaccaacaaagatcaaaaaagacaaagaagggcattacataatggtaaagggatcaacacaaccagaagagctaactatcctaaatatatatgctcccaatacaggaacacccagattcgtaaagcaagtccttagagacctacaaggagacttagactcccacacaataataataggagactttaacaccccactatcaacatcagacagatcaaggagacagaaagttaacaagggtatccaggacttgaactcggctctggaccaagcagacctaatagacatctacagaactctccattccaaatcagtagaatatacattcttctcagcaccacatagcacttattctaaaattggccacataattggcagtaaaacactcctcagcaaatgcaaacaaacagtctctcagatgacactacaatcaaattagaactcgagtttaagaaactcacttaaggccgggtgcagtggcttacgcctgtaatcccagcactttgggaggctgaggcgggcggatcacaaggtcaggagatccagacatcctgactaacatggtgaaaccccatctccactaaaaatactaaaaattagctgggcatggtggcgggcgcctgtagtcccagctactcgggaggctgaggcaggagaatggtgtgaacccaggaggcggagcttgtagtgagccgcgaaggcgccactgcactccagcctgggcaacagagcaagactccatgtcaaaaacaaaaacaacaacaacaaaaaagaagctcactcaaaaccacacaactacctggaaactgaataacctgctcctgaatgactactgactactcggtaaacaactggtacatttgttatttttcaagttaaataatgaaattaaggcagaaataaataagttctttgaaaccaataagaacaaagacaaagacacaacatatcagaatctctgggacacagctaaagcagtgtttagagggaaatttgtagcactaaatgcccacaggagaaagtgggaaagacctaaaatcaacccctaacatcacaattgaaagaactagagaagcaagagcaaacaaattcaaaagctaacagaagacaagaaataactaagatcagagcagaactgaaggacatagagacacgaaaaaccccaggagctggttttttgaaaagatcaacaaaattgatagactgctagccagaatcatcaagaagaaaagagagaagaatcaaatagacacagtacaaaatgataaaggggatatcaccactgatcccacagaaatacaaactaccatcagagaatactataaatatctccatgcaaataactagaaaatctagaagaaatggataaattcctggacacatacagcctcccaagactaaactaggaagaagttgaatccctgaatagaccaataacaagttctgcaattgagacagtaattaacagcctaccaaccaaaaaaagcccaggaccagacggattcacagccgaattctaccagaggtacaaagaggagctggtaccattccttctgaaactattccaaacaatagaaaaacaagggactcctccctaactcattttatgaggccagcatcatcctgataccaaaaccagacagagacacaacacaaaaaaagaaaatttcaggccaatatccctgatgaacatcgatgtgaacatcctcaatacaatactggcaaaccaaatccagcaacacatcaaaaagcttatccaccacaatcaagttggcttcatccctggaatgtaaggctggttcaacacaggcaaatcaataaacataatccatcacataaacagaaccaatgacaaaaaccacacgattattgcaatagatgcagaaaaggccttcgataaaattcaacaccccttcgtgctaaaaactctcaacaaactaggtgttgatggaacatatctcaaaataataagagctatttatgataaacccacagccaatatcattttgaatgggcaaaagctggaagcattccctttgaaaaccagcacaagacaaggatgccctctctcaccgctcctattcaacataacattggaagttctggccagggcaatcaggcaggggaaacaaataaagggtattcagataggaagagaggaagtcaaattgtctctgtttgcagatgacatgattgcatatttagaaaaccccatcgtctcagcccaaaatctccttaagctgataagcaacttcggcaaattctcaggatacaaaatcaatgtgcaaaaatcacaggcattcccatacaccaataatagacaaacagagagccaaatcatgagtgaagtctcattcacaattgctacaaagagaataaaatacctaggaatacaacttacaagggatgaaaaggacctcttcaagaactacaaaccacaagcaaatggagaaacattccatgctcatggataggaagactcaatattgtgaaaatggccatattgcccaaagtaatttatacattcaatgctatccccataaagctaccattgactttcttcacagaattagaaaaagctactttaaatttcatatggaaccaaaaaagagcccgcatagccaagacaatcctaagcaaaaagaacacagctggtggcatcacgctacctgacttcaaactatactacaaggttgcagtaaccaaaacagcatggtactggtaccaaaacagagatatagaccaatggaacagaacagaggcctcagaaataacaccacgcatttacaaccatctgatcttttacaaacctgacaaaaacaagcaatggggaaaggattccctatttaataaatgatgttgggaaaactggctatccatatgcagaaaactgaaactggaccccttccttacaccttatacaaaaattaactcaagatagattaaagacttaaacgcaagacctaaaaaccataaaaaccctagaagaaaacctaggcaataccattcaggacatatgcatgggcaaagacttcatgactaaaacaccaaaagcaatggcaacaaaagtctaaattgacaaatgggatctaattaaagagcttctgcacagcaaaagaaactatcatcagagtgaacaggcaacctacagaacaggattaaattgttgcaatctattcatctgactaagggctaatatccagaatctacaaggaacttaaacaaatttacaaggaaaaaaaccatcaaaaagtgggccaaggatataaacagacacttctcaaaagaagacatttaggtggccaaaaaacatatgaaaaaaagctcatcatcactggttattagagaaatgcaaatcaaaaccacaatgagatcccatctcacaccagttagaatggtgatcattaaaaagtcaggaaacaatatgtgctggagaggatgtggagaaatagggaatgcttttacactgttggtgggagtgtaaattagttcaaccattgtggaagacagtatggcgattcctcaaggatctagaatcagaaataccatttgacccagcaatcccattactgggtatatacccaaaggattataagtcattctaatataaagatacatgcacacgtatgtttattgcagcactactcacaatagcaaagacttggaaccaacccaaatgcccatcaaagatagactggataaagaaaatgtggcacatatatgccatggaatactatgcagccataaaaaaggatgagttcatgtcctttgcagggacatggatgaagctggaaaccgtaattcccagcaagctaacacaggaacagaaaaccagacactgcatgttctcactcataagtgggagttgaaccatgagaacacatggacacaaggagggaaacatcacacataggggcctgtcgggtggcgggggtctaggggagggatagcattaggagaaatacctaatgtagatgacagataatcttatgtgtcttaaactttgcaggcacaaaatccagctaatgtatggagtttcactttctaatacatgcaagttaacctgcttttcaaggtacatgatgttcagtggctaaaattctttacagttctagatatgagagatttcaggactgtaagcccattattttgcttcaaacatggtatctgatctcatacttaaagagcaatgagaaatgcttcagaaaagggagagcactttttaatatattctgaatgtattaggatgcagttatcatatcttgtaaggttgaaaattcaggccgggcgtggtggctcatgtctgtaatcccagcactttgggaggccgaggtgggcagatcacgaggtcaggagatcgagaccatcctggctaacacggtgaaaccctgtctccactaaaaataggaaaaattagctaggcatggtggcaggtgcctgtagtaccagctactcgggaggctgaggcaggagaatggcgtgaacctgggtggcggagcttgcagtgagccaagattgctccactgcactccagcctggatgacagaacgagactctgtctcaataaaaaaaaagaaagaaagaaagaaaattcaaccccagtgagacaacagaactattcattgatcagaatactcagaaaagcagtattatatagggataggagggtaggcaggcagtatactgccaccagtaaatatatttgtgagttctactaaagaggaaaggagaccccttttggagtttttttgttctgttttgtttttgttttttagttttctcatgttttatcctaatgggttttgaaagcatgatcatttaaaatactgttggaatgggcccatcagtgatgtgatctttcacctgtgaaaagacaagggctacttttgtggctgtatctcccctatccagacaggtaggagacccagcctctgtggctttatgccggacgctcatttcctgcccacagagtttctctgcccttcaggataactcagagtttgccagccattgttgggtctatccaagggtgtgtagttcacaactgcttccttcctttttccctagaagggtaaaggttaccccataagctaaggggaaaatgcccagcccagagagaaaagctaagcagagcgagcctcttggatcctgagggtctagcagagggcttataatatctcttcctattgccagtgccccagttgcgcagctctctgcgtcttttctcaaatcatcacccaatccgtttgccttttatagaaagtgatggtaatgatgtgtgtagagtgacagacttcagtttttacatagaaagacgggatgtaggcagtgggatcaggccaacatcagccttgggcagcgttttcagtggggaagcctcctcattagaagagccggcagcagctgtgtgactgcctcaggctgaagagagtcctgggagggttggatgtcttgttctctcctactggatttctaccataataataataaacagatttatttttctagtagttctcatttgactagacatggatgaggtaaattttcaggaaaggcacaacagtgtaatggatttttatgggtaaaatggctatcataaaagctttaagctaaaactttaaaggggtttgataacgagggtacattaagactttggtttgcaattatttacttaggaaggatggaaatgtttgcaagtttgaatttggctaaaagcccttcttaattgtaaaagaatcacttttagatgttcacaagctgagctttagcaaatacctttactggttcttgagttgcctctatcttagttttcccaccattgtactttacagcacaatttacaatatgtccccacccccaaaagagcatttcctttctcaattgtcacaaagctgctgagaagaagcttatttttaacttggaaatgtgttttgttttaatagttttagcctgagagcaattatcttacacactttataggtgcctaatgcggtcttaaatcatgactgaccaaggtttatcaataaatccattgataacataccagaaatgagtctgcaataacaaaatgagtctgttatttgcttaacatcaaccatcagggggaaaaatttaatcctaaaaatgagatataaaacaataccaatgaagataattaggaaaaattgttacaatactgattttgggccctctctggttccgtttttatctatttctaaaagaaacaacataacacatgtattaaatattacataatttttaaaaggctgagtgtgtcaactaaccagcctggtatacatcaaatagtgaccatatttaaagaacaaggaaaaatcttcagtcattaataaatgtgaactaataggtaaaaagaagtagattcacttttcatttgttagtgcctggtgcataggaggtgctttattaagaaataattaatgaaacctgggcagcataacaagaccccgtctctacagaaatttaaaaattagctgggtgaggtggcgcacacctgtagtcctgtctactagagaggctgaggcgggaggattgcttgagcccaggagtttgaggctgcagtgagctaggactatgccactgcactgcagactgggcaagagtgagacccccatctctaaaagtaaataagtaaataatgaatgaatgaatgaatgaatgaattattggcagatatgtgttccaaaaccatctatatgtttcatattatgctagctgctgaatgcaactgggcaaacactggataccaaatgaggtatttttactgtgcaacttttgtctctgggtggggaataccatagcaaccagaatgtagtgcacgcagccagtgcacagagcaaggcgtataatggctggaccttggcttatagagcacatgaaggagtttgataagagctcagtccgaaggctgatgaagagttacaatcagagttatgagcaagtaaaagtctgggcccaacgtgtttctactcctaccctaaagagccctagaagatgaattcacttcagaatggcccaaaaagggccaggtccaatggctcatgcttgtaatcctagcactttgggaggccaaggcaggaggatcacttgagcccaggagtttgagaccagctgggcaacgtagtgagaccctgtctctagaaaaaaaaaaaatagccaagcatggtggcccacgcctgtgatcccagctactcaggaggctaatgtgggaggattgcttgagctcaagaggttgaggctgcagtgagccatgatcacgccactgcactccagcctgaacaacagagccagactctgtctgaaaaagaaaagaaaagaaagaaggaagaaaggaagggagggaaagaaaaagaaagaaagagagagagagagaaagagagaaagaaagaaagaaagaaagaaagaaagaaagaaagaaagaaagaaagaaagaaagagaaagaaagagaaggaaggaagcagagaaaggaaagaaagaaagaaagaaagaaagaaagaaagaaagaaagaaagaaagaaagaaagaaaagaaagaaagaacggaaggactcgaaaagcccctttattcctaccaagctgcatctgctctttgtcccatctttggatctcctgaaaacaacttgtttcattaacatgtcatgtagttttaatgtttgttccagatgctctgaaatttgtgacccttttccctttagtgaaaattaaatttttactaaattgtgggaaaatgaaagaatttcagactatttaaggatatacattttgtttgttcgttttccatatatgtgaaaaattataatatattgggtttttttaaaagttctatgttgtccttgtaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacgtaaggatcttaaaatgctttgctggggtgtgcttggaaaataggttttgtttttgaatgaatatttcttttaaaattgctcaagaagctcatctcttgaattaaaaagggtcttggcctgtcacatgccttgtgggtctgttctgttttgttcttgtaatcccatttactcattggatttgaagagagagaaaggtgacatggcctaggtgaagagaagaggccagaaatgggagtttctcaaccatttatgcgacaagtcttcaggtgttgtctgagtagatttgcaagagtagcactagttgggatcacttcatccttggagtcttcaaatgtagagtctccaaaggctttttctacagaaatcagtaaacagctcagcatggatcctctcttttaaattcactttctaaacctcagaaatgtagtgaggcagctgaatcacgtgtttgagacttttttagatgagttaaaatttatattcagcttatatttactggcactgcaatatatgggctgtatctcactgaaccatccccacggtcctgggagggagcagtatcattcctataatataaaagaggtacctgaagttcagagagatgaagtgtggcttcacagaggtaatccagagagtaagagctgaacaagccttcagctcagctctgatcatcttctgatccaagacccgtgctagttctactgtattctacatgtacccttctacaagctttgaattccataatcatcagagaatccagaaattattcattatcacataataacaacactcaaatatttaaagttttatggttgaatctttatgattgaacccattctatcaggtggttattttatatctaatagaattcatttcagggttacacaaaggtccgaatctatccattttactgagaccaaaacactaatgaaggtaatatttgttagctgaatggcaaaacaaattttttctagaaatctcccttgtaaaatctccaaaactcttaatcattgcatataaatcaggacctgtaaaagtaaagcataattcattctctcctttaaaaagttatttaataaatcaaattgtatttaaattttctcagaactatatgattattcattcagaaataattctatggaaagccatcacaatttcattatcatttaagtaatttaaataagcatgtacaagtataaccacagaaatgtacctgttgacatactttaatgaagagattggcctatttgtagttagcccattgtttcatatgcatctgaagtggaccaaagattatccccaaatattaatattatccaaacttagattattatgcactattcaactggtgaggtctttatggataaggtctgatatttcctgtttgtctgtataagtgctatagtaccattaatgtaaagtttagtataagcagggtgcagtggcttacgcctgtgatcccagcactttggcagaccaaggcaggaggatcacctgagcccaggaattcaagaccagcctgggcaacgtagtgagactccatctctaccaaaaaaaaaaaaaaatttttttttaattaaccagatgccgtggcatgcacctctagttccaactcctgagtccagaggatcccttgagcccaggagttcaaggctgcagtgagctatgactatgccactgccctccagcctgggtgacagagcaagatcctgtctctttttacataaaaataaaagttaagtttatcatagtatagaaataggattatataatttttggccttaatgcttatcttgaaactctgcttgctattcaaagcagtcagctcaccatttagagttaatgtcacttcctataaaacaacctaaccagaaaattccttggatttgtcatgtattaaactttgggttttttttccagattgaaatgcacagttggtcctgccatgaataagcatttcaatatgtccataattatttcaaatggccacgggacaacacaatacagtacattctcctatgtggtaaggaagattctatcctatcatgtttgatttttacttaatctatttaaattataagatgaacaagttactttgttttgtttttatctcccctccaggatcctgtaataacaagtatttcgccgaaatacggtcctatggctggtggcactttacttactttaactggaaattacctaaacagtgggaattctagacacatttcaattggtggaaaaacatgtactttaaaaaggtgttgtaaatttattttttgttgcatctgtcaatttgaattaatatctgtaccttaaaaattaagcagattgttttgtgtgtgtgtgtggagaagaaaaatcaagatgtttatttgtttactctcctactgacaaaacttcctccttccaaaattcatctactccttttgctgatttttcttcctttctcttgttttttagcaatcctacttttcagttttgtcttcccatccaccctctttattgttatagcttaggatcttagctatactatgagctgtgagagtctggtcattgataataatttaaaataaacattttcatcaagatttgtaattagactaagtcactctggggaaggaagaaatggggaaaattgggtctggaagacagttatgtttctgcttcttagagttggaagagctcagtttaatcaagtaccaaaagtactttaaaggtttttttttcaaatctcaaatgttttccagtcaaggatagcttgtccacaacaaaggtaagtttgagatccagtcagattaaacagcctacactagaaaaggcttccactcaggaaattcccacttaggaaccattgagttatatccttttgatttgtggatataattctaaaatatgtgtatctctaatagctaaaattcacttccttaattttttttgttcagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggtaagtagaagcttctgatgggtataagaaaacaatgaatacaaggatgattttgctgtagaatagtcaagaggaattgcagttttatctctggctttgatgctgttatgttgcttttgaaggcttctttccaattcaggagagaaaactatattcaggttctgagtgtagtttgacttatcaatgctagttcattccaagaagtatcttatcctgttctattacatttaaacagagtatagcaaaatagtttaatgtggcattgtagtatacatgcacttacattatgtacatatcaattctatactaaccttagtgcccagaagtggaattaccttttttcttccattctctagatatgtttttgtcctgcctgctttacacacagcttttctttatgccagactctctttgaattgatatctcattggacccagttcaatctgccttgtttccgttaattctatcagtctagcaacaatagttaagttcggttttctttgtatttttttcagaggtgaaatatttattttgtgtaattcggtgaataaaatacaaatgcatttcttaagcttatgaaatatgcattttaaaaatattttcaagttaaataagttgtttccaaagaacagttacccatgaacttccatttgatgttgactgtgcctctgacctgtaatcagtgcaggtgattaaattgaatccctctcttacagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggtaagtcctttgagcaatggttctactcagagctctgcatctttgcctctaaccatgtggctttcatggtacctgagacatctcagtttcgcctttaaggtttgctagttaatttccttgcagtgtagccaagtagtattttttatttaataactgaaattatctagagtcttgggctaaccatgtggaaaaaatacatacacatacacacatgcacatataatgtttagacaagaatgaagattaccaatttgagacagtgtttttttatgtttgttggttggttggttttgagggtttttttgagacagtatctcaccctgtcatccaggctggagtgcaagggcacgatctcagctcactgcaatttccccctcccaggttcaagcgattctccacctcagcctcccaagtagctgagactacaggcacgagccatcatgcctggctaatttttgtattttttggtagagacgaggtttcaccatgttggccaggctggtcttgaactcttgacctcaaatgatctgcccacctcggcctcccaaagtgctgggattacaggcatgagctactgtgcctggcctgaggcagtgtttttacagacagtcagtacaaatggaaatcacagcatttccctagtccctttttaatgtgtcatagaacatggacccttttgctctaataaaatccttggaaaaggttgctgatcttgcagcagtattcttgcatttctaagcagctgacgtatgctttcttacagccccctgttcttcttatcattcttcttgtccctttgttagctctttcttgaaagagctaacaaagaaagagcattagaatatttatgttatgtcctaaagtgtgaatgttatttgctgtttctccacctatccttattttatataggtcacattaaagtggtagttttagtttagaccttagaaagcttggagttatttccaaagattccatacattttgttgatgtttttctctaatataaaataccataatctagtaggacttgagcactcaactcagaatgaaagttctaagtgctcttgctcaagcaaggtcttgattggtcaggtgatagattgaattacagcacttccttttagattctccatccaatatttcttgaagactaaagccacaatgttctttaattacaaaaaccaatttggggctaaaaatgtcaagccaaatcaccaaataataaggtcatttcaaataagatttttcttggccttctcaatcagccacattgcatcacctctagagagtattattagatttttatcatattcctgagagattgtactctagggagtcaccatatgaagcaaagcattttgaaaccaatccccacacatggccacaaacaaagttagagtaccactgctattaatttaaaggacatcagttctccacaactaagcataacaatgtttcattaaccaaataagaataatagtgaccctctttggtgttggtatgagaccttttaaagtagaaatctgagaaattattagtttatctaattaatgctgagcctccattattaagataatgactgaatttcctttcttctccctcattggcattaaagtgacactcagaatgccttagcttcagtcattcatttgtaatcaaatatttattaaaaactttttaggtgtcacacatgagagttacatatcccaaggatgattcaaacaatggtagacgataaaaatcttatttgtttatatatctggaaatataaacttctgttgttttagtgacaaacatgttagtacagtagaactgtacattagaatcggacaagagtgaaaaattcagtggatctattttactatttactatttattttactgtcgtttgtgaaaagtactttataaggagatatgtattcattccatgttccttgccacttatagaatttaaagctgaccatgatgaattgaacccatttattatttaacaaataaaaactcttggtcaggtctgatttagatatataggtccagccacaataactttaagtccaataaacttgaatcctttcaaaacaagaacaatcatcttcataacaaaatgtatattaaattgttaacatgtgcattatgccctaggagcctgcagtttattgtgtagttctcaaatttcttgttatgtaaacaattattgtgatgacagttaaattgttcatgtccatcaggaataaataacttttagcattataatattaattttatataaaactaaatagtataattttatccatattatatctctatcagttttatctgctgcctatatacatttttaatgtaagatcattttttaaatgattttttaaagaaaatagcaaataacaaattctgtttgtcctttttatgtatatcctgagtcctttttctattgtgggcataagtaattgttttatctccaactatacttgtcaaagaaaaggaaatctaagggatgttgttgcttgtttgtcttttccttgggggaaaaatgcaaccgttaaccttagatgtaccactatgtgttgctggtttagtctaagtacaatcaagaggaagctacattttccaaaattccataaatcagaattccaaagaggaagatttgaaatgagacatgaaagggcatgaaataataatagcagaggctttgtaaaatagagagcataggaaaaggtttcagtataaaatatgtcatagacaaaaagatagcatgggagtgaagacactgaattttggagttaatggcctaggatttatattcgctattctgccactccaagctgtgtgacctggcctaatgacataagtttgcaaagctcagtttcttcatttgtaaactgtgggtaatcataatacccacctataggattatcaggagaattaaatgagaccaactttgtaaagtattttgcacagaacctggcattcaataattaatagcttaaaagacactaataagattacctaacaacatagttaattatcatgttcaccatatggtgcttggtgctttacaaagcactttaccatgtggtatccaacatggtaaatagcattttcatcttaattcctaaatgaggaaactgagttattcagtgtgggccctaccttagttcccatagcttgggttaaagctaggagatgagccaaggccttctaaccccacaaagctgagctcccagtctgcctgactgcctcacacaacaaggggcagttcctccaggtgactgtcctgtcttcttaaggaaaataaaatgatgagatgaaggccagcttcagatagatcagcacagtttatgctgggcaggtggagctctgtgtttctttgaagggtgggttgtttggataattttgcatgtatcgtgtttccagaaatgtgtagtctaacattaggaagttaaatacagattttttcaaaaattatatattttcaattgattggggtggtaaattataaagttgctatggatgttgccaagctgtattctgtttacagtggataattgtgtctttctctaggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaaggtaagaaatgctttaaacactgtcttaaatcatcagctcaaacttaattgacttcatagctatgtgaatacaattgttgtacttggccattgtatcttatacaacaccagcaaatatataaactctgaaaaacaaatctttttggcataaaactaaaagataagaataaccgtggactgcattttaatgaagcattaaaaaaccctttcttgtgtatgtattaaaacgtagcaaatgtgggacacaaattatccattaaagaggatccgcgtcatgcattatcttgctgatgttatacatttccccggacatgttacctaaatgtgctcattataagataaaacataagagctgtgaaagtaaatgcatcaattgtatctccgttcttccttgtaatacttggaattttgtatctgggtatggtcatctctaagctaatttgtaaatggaactagatatctgccaccttaggaacatattagcttctaaatgtaatttaatagagaataacagatcatcttttctaaagcaagcctgttgcaaacaaagaacactaagacccagaaaggttaagtgattgacaagtgacaaaatagtggcagaataataaagactagagtgcagcttttttatgtcccttcagtagtttctacttcaaataataacacaggcaaaatgctcaagacttgaattattcatagctccagtcactagaaacagcaaaatatttatccttcaacatgttgttaaaacatttagaattttttttcctgaaagatgatctgaatgcaaatatgaacaaacataaagcaataggatagtctttatttggttgtaatataggctttcatgggtcatctccatctaagtaataatatgtttccattgaaatttttctgactttttcaacaaaaatttaactgcagcccaacttatgcatatgttcacgttcatacaagtttactaacctcattattgtgttttgtacaataattaagcaagcccagcataaaattgaatggaagcccgcttcaatgaacagtgtgtttacaaaagcaaagttctttcatctgcttctttaattagttttagaaagggagaaataagcttttatcacttctttttttttaataaaactaatctagtgtgaccttttgctttcaacaattactgtgtttgccatttgaaagattccatttggtttttcttgatgataacaaaggtttatgtgcaaatagttttacactcacagaaactctatttttctgttcctgtatctatgatgaagggattagagataaacggttctttatctacccttccaagcacagtctttatggaagagaaaacttctctttccataaattaaatacccattattcaacatcctacaaaattgttggaccaagaaaaacataatttggcatcatcctcggcctgtcaatggtattcccaacatggcgaaagggtcttctagagactggcaaaaaacactttattttcttgcctatatatggaataactctttctctaacaagtgtatagcacctgccacgtgacagaatagtaatctagtgggagcagtggcaattcagggagattattttagtatcatggttcaatattttttcatacttcatttttcttatgtatgagaggaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctactcaggaggctgagggacggaggtgacctgagtcctgaaggcggaggttgcagtgagccaagatggcaccactgcactccagcctgggagacagagcaaaaaaaaaaaaaaaaaaaaaaccacgtacttcatcaatgaaagtgttctggagagaatcatgtgtttagaatgagatatgctctttattgccaggaagatttcatgctcctcatgcagccatgcatgcaagagttcctagggtgaaaagagattgtgatcattccctgccctagttgtgagagtccctcaattcatagtaagcccagtgactacaccatgggcaaaagggcgagccaggtttggatgagggaacacaataggggtcaagcataagtcacccctcagaatgaatcctaagccccatggatggagaaggaagtttttggccaaggcttcaagtcccccaagagcagtcgtagacagtggtcatcaaaagtaggtacctctttgtgggtatacatgactccccaaatgcctctatcaacaacagctcatgtttgtatggaattttacagttgacactgtactttggcatattttatttcatttgagtctcatgtggacccatgaggttgggaggtcagtgatgattatccccatttatagataggtaaacaaaggtttaggaagattagctgatttgtcttgggtcacccaggaagcaaagagcagaactggggctcacactcaggcttcttgattccaaatttggtcttctgtcactgcatacactaaattacagtatttcttatattaactctcatttaatgtatactaaaataccattatagagacacttttctatcatatgctatttatatatctatgcagttctttagagggaatagctcttaactttttataaatatctaaaaatttattctgtttaaagaaactctgtatttctccctgagtgtcttatttctgactttttatgcatgagcatatcttatgaaaagtagaaaagtattctgtttcatgctggaacaaggactgcctgacattgccttgggggtttatcttattctgcagcatataggaacatatgagaataaagatgcttcaaatgttcaatctggagaagtcaggtcaaacaggaaaaagaagcacaggaagatgagccagggcagggagcggggacttggtctatgacactgtcatcacaggaacaaatgctgagagctcaggaggaggtgaagcatcagtgtgtgggcattggaaggatcaaaaaggaagcatggttttgaaccatcctaatccacctgctgcccagagccagccagatgttgtccttctccctttgaataatttatgtgcaactctacccctcaatctcagtcaaaaccaccatgaactcagttctgagtccagacaggataaaagtgaagggttcttttttcagaggttatttggcccagtgtcgaaacctgttcttattaatggtgctcaacgcttactctcaaactagtatttctttgtgctgcccaggttaatgggcattctgcaaaatatatatatattctttttccagggcagtttcatagtatctaataataaagatagtaaaaaatatattcctgtggtttcatggtacctagtagtaaaggtccccaactagccagcaaagccaccagtttaattttggtttgcccagcttttcccaaatggccagggaagttttccccaaaatgcctattaacatctggtggaactcagttctgaagctgtctgtgaggttcgttgcttggttcctaagttgagggacttgtgtcctctatgtgaagtgtaaatctcaccccctcaccaccacctcactaatttcctactgctgatctccctggactttggaccctcagcctggctgagtcctgctgccaaactgtactgacttgcccagacccagcctgtggccacctgggtgtatgaaaacttgaaggaccctcctctcatagtgttatttttcagatcctacccacttccactcccatctgctcggttctgtaaccatctcagacatgagtccccgggtgtgaatactcaatagaaacatgtcacacctggccagggttggagaggaaagagacatggtacatcctgatatagcacattgggagtaattagttttcatttttgaaatggatccattttgacattgcagtgagaggaagaaatccttactcatctttatattctcagtgactagaactgtgtctaacacacagtagacggtaagtagattttgtgtcaaatggaatttgatttgcttcatgatctagcccctttctggataatagttctccatatgtaaagcagaaatgacaataatacctacttcagggggagtatctttgcaggataatatgagatgattataactaaattgctctatgtctgttggagattaaagatcagaaagctctctctcttttgttgctttatttttaaacccacatattaccattttagtgactgaaatcaccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagaccttttctcataaatcaaatcctacagctctttaatctcttttctttgtcattccctgaattccctccaatatgtggataagggttttatcccccttcagacctagccaacaagttgtcgtttgaagccctaaagtcatctcttagattgctgagcttctgtgttgtgttggcctgtgtggctgacctggttcaatggactacacatactgcttctagaagtatcataaggatagggtttgtctatatccattttatctgaaactccaacatcaggttataaagaagtattttcttcccacttcttttcctagaataataactgcctgaccaatcaatctattgagatccgtatgagaccatgtatgtgaatggagtttgccgagtattaaagattatataaaacaaaggagcagcattttagctattatgggctgctctttgttagtaagaagaatagtaatatgctttgatatatgtcacctcaaaataatagcttgctcaataaataactgtactcattaagtcttgatatgagaaattatacctaggtttgcacttctttcgcaaggctaattattggtttctcaaacaaaacgttgatatttttaaaatgcctgatggtaacttcagttaactaaatatgccacattaactaatttttaaaaaatttttgtgtaactatgtaattgttcaaaataatggaattgtgctctcaaattataatagtcatacagcatctcacataaatttcttttaaaatgaattcacttatgtataggactcaagtgtgcaagaaggatgaaagtaaactacccaactcaaacaaaaaaagaatgtattaatattaacataacataatacagtgttaatacattaacaactatttaacatcagatctctggagatgagacccggacatcagtattttttaaagttttcacggtgattccaaaagcaaagtcaaggctgagaatctctgcattgggcagtgttagatagtgcaacaactgaatctctacattgcgtcttttttgccaaacattgataccccctgaggacaatggtgaggtgatgataggtaagacatcattccacatttaaggatgtgaagcaagaacctctttccttttctttaaggtccaatttgatgcaaaagctatatgctataattcctaactaacacatgccctgaaatggtcatgctcccctttagccatcccaattcccatgaaaattagtatcatagaatcgtgtgccttggcaaacaacatggcctgtgtttgcagtatatttatattcctttgccattgttagcattcctgcagaactgtgaagtgttaacaacctttttttttttttttcctttcagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactcagcctgcattcctagttgttattttagaaatagtgagctttttgccacattgtctccttccccaagcctgggaggtagatctcaaaagttctttctacccacactgcttctccatcacgccacactcttcccaaaatttgctgtaattctcagaagaaataaggatgcatccaagagtgtccttctactgcctcccaccaccccaggaggccagagccagtgttccactgccaaccactgtgatcactaatgcatagagtcccataaataaaggaagatgcatgcatcaaacaaagtaaaataaagattaaactactttacagtaacttttttcgtgtagacaactgaatcaaacaagctagaaccaaagcgagtgatctttttcattctttttttagcagctttattgtgatgtaattcacataccatgcaattcacccattgaaagtgcacagttcaatgggtttcagtatattatattgtcaatttctttgaattgaggtaaaatatacataatgtaatgtttgccattttgaccatttttaaatgtacaattaagttgcattaatttcattcacagtgttgtataaccatcagcattacctaattccagaactttttcgtcaccccaaacagatactctataaccaataagcagcagctccacatacccttctctcccccggctcctgataacttccaatctactctttctctctagaatttgcctattctagatatttcatgtgagtggaatcatacaatatttgtctttttatgtgtggcctattttacttaacataatgtttatccacgtggatgaacataagattcatccacgttgtagcctgtgtcggtacttcattcctttttgtggatgaataatattccattgtatatatcccacatttatccaagagtaagtgatttttaaagggttcctgaagtcttctgaagttataaaatggaaaaacacacaaaaattagaaaatcaaaggctgaatcatgagatcagagttggaatttcagaaggaccataaatcctaaaaatcataaaatgttagagccagaagggacttcaaagatttctgctgtgtatcaaaactgaagtaaaaatattctgagactttattgttccatcataacagtacaattatttacctcttatgggaagtcttctctgccctccaccccaccgtccaggacagaattaatgtcccattgtctctgttgattactgtttagtcatacttctatggtacataccacactgtactggaatcatttatttatatgtctgtctccccttctatacttcagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttctttatttgtcatttttagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaaggtgcatttttgttactgttcatttttagaagttaccttaagaacacagtcattacagtttaagattgtcgtcgattcttgtgtgctgtcttatatgtagtccataaaacccatgagttctgggcactgggtcaaagtctcctggggcccatgatagccgtctttaacaagctctttctttctctctgttttaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagttacaaaatatacttatttaaatgtaagttggaactgctacattttttacctgttgaagcccaaacattgaaattatactgttagtaattcttcgaagtgttttcaatgaactgttagtacacagcctttttcccaccatattctaggacttgaatgtattttgagacttagccaaggaaaaccttcaattatgccatgaaaaaaaggaggggtcaatatcatcagctttgtaaaacactatgcctagtaatgttcaggttaatcagagttttcatgttgttttatttaaatctcctggtaaaagcaaaaggtctgtattgtatcagctccattatctttagaagttacaggatgtgagtcaagtacaagcatttccttggttgaatatttaccattggacaaataaaatgagtcacagatcattgaggatactggaaaagttagaagttgctcatccaaacaagttcaagagcaatgaagcacttaacattttaacattttcaacacttactacctcttatgttttgaagtttatgttatttctatggagatacacatagtaaacattgtctttgccctgattccattcacctttaaaaatccattcgtttaaccgtgtggaaaaatcaaacctagtttattgttttgaaatttagatctatttagtattttatgtgcacatttagtgcatctatttagtattttatatgcacatttcatagttctaatctgagatcattaaaatttacaaattttctttgaaaaaaaaacttacctaatcttctttgaacctccttactcaccaaagctctgtcatcattgctaagaaggttgagtttcacactcttttctccattgagcctgctccttggagacatgaaaagaaaacaggtaaaagagggtcatttagagagaatgagaaaataggtgcacagccaaaacctaatgaagaggcaactgcagagctttcctctctacatctggtggggacagcattctcatcagactttttcacggagacctagagtgctatgtggtgtgacatcagggtggcacactgatggtttcaattggtttctgcacatgttggaatttagctgaagagtcacgttttcatgccaaagggcttttatccatgtctcaccaaggatttccctcaatctgtgcacccttaagcatttagagccctgatctccagatgcaaaggctttaggaagtgagaatgaaagacctgagtttagagaggctgattggcattcccaatcccctggggaaggtttagagaccctgactccttggaattaagggagcaagtacccagctaggctccttccttcctcactcacccaacatttcaggtacttcactgatgttccacatccttctttaaaggttgctcttgtcttttttctggctagtgtctactataactgtaattgatgcccaacgcttttctggaaccacttttggccaagttcatttattattaatcaaactgtccactgtagaaaatactaaaaatgctcaagtgggattaggaatagtcaaggtactaacagcattctttttatgcccttctctcagattctgattctcctgcttatttgcaaacaaatgatacattttggtgctaatgaggaacccccacataaccttctccctgtgttacatactaatacatttcaatactatgcctagtttatcttcatgtcagttgctgtggctatgatgccccctccttgatatgtgtgaattcccagtggaaagagaaagggaaagtggaaatgccctatttggcattaagaaattgactatcagcaccatttcttcccctgaaataaaaaaaaaaattctccttgcaaaagggaactttgcctgaggttcttacagagctttggttataaagatcaacttataaagaatgcttacccctttcatagtgtccttaactaaacaacaaggatggtccactaaccgagatctaacctgccttctctaaacaacagtaacactaaatccagtgccatcactgcacagtggagaatttaccactaatgtgaaaagctttcagttttgggaatatagccattatttatttctaatcatatgtgtatttttcccttggccaggaatccataggttttgcacaatagtaattaattccattaacaaatagtagtgtctcaaaaggcatctttttcattttcttatatttgagctggatttttgtgagacgaggcaattgctcaactacctttgctgctaccactgcttccattcttaaggacatagtatattcaaaaataaaccataagcatggctttttgctattgataaagagagaaatgtctaaggaaatgagggtaaaaagctttcaaaattaatacttagtctacttaaatgaaaatctgtaaacatctaatgaaatgcttgtatatataacttagtatcttttcccaatttattatcatttttatcaaactaattccattataaaagctcttcctgtttcagtccccattaaatgaggttttactgttgttctttaataattttccttcatcttacagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagaggtaagtatttccactcagctttttgttaaatacgattttccagtaagcattttatctttggcctttgcagattaggaacttagacaatggtgaaagcaactgacagagcagtgataacaagtgtacttgatttctgttctatagaaatgtagccctgtaaatcatatccgtggggatttgcccttgtgcatggaagcaattggataatcccccaaatatattagaactaaatcacaattcgtcctcgtcctgtgtgtactagcaattatagtttcttcaaaggtgccatttactttcttctaaaactcagggccaggcgcagtggctcacacgtgtaatcccagcactttgggaggccgaggcaggtggatcacctgaggtcaggagttcaaaaccatcctggccaacatggcaaaaccccgtctctactaaaaaaatacaaaaattagccaggcgtggtggcgggtgcctttaatcccaactactggggaggctgaagcaaggagaattgcttgaacccaggaggtggaagttgcagtgagccaaggttgtgccacagcactccagcctgggcagcagagcgagactccatgtcaaaaaaataaatacttataaataaataaatatcactcctttaattttgagtatttttattcaatctctctccagtctttctttaccctgagaacagtgacaaactctatgaagcctggtttatagcagtttgtacactgctggacagcatcagaagacagagaatttatagcattctcctgatctaaagcaacatatatcatctctacaatgcactccaatttctttatacaaagataaatgaatatttgtaataagctagccaaagcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttctgtcaaacaccccagagcgtaatcctttgtgtgctccttcttccccaagagtggcttcactgttaacaaacatctttccatttctcttcagagtaatatatagttctgtcataggcctataaatcccagtaattgcatcaattttagagtgtgtggactcactaattgtgttctaattctacacatttggaaaactagaattttttatcatgaaaggtactaaaatggcaattatttctcttttgaagttataatcattaacagctctataaatattagctactatgtatttatatgtttttctgcaggagaataggagcactcaaaagcataagttttattttattcttctttgcattagtagagggcagcctaatgcctgacactcacatactaggcactcatggtgtcttggccagctggatgaattaattagtgaatgacttacacagctatcagacatttggcacctctgggggaaattactgccactggataaaaggctaccattgggaaaatgatgtggttaaagccagagagaactggatgaagtgagtcagggtgaatttgcttcatctgggcaactgcctttcagtttctgccaacctggattacgtattaaccagtgactaatggggaaatccttattctataatactaatcctatttttaatggtaacatttttatttcatttcagcttattagaatatagagaacttattttattatagttcttcatgtgggttaactttattttcatattttaaaatactatgtcatcctttaaaaaaatttatttgatgaggccgatgttactcaccttttcagtggttccactgtggttgaatattttattaggttaggctttaatatgagtcatatcatctacaacttattcatgaattaaataatcacattgcttatatccttgggtgaaatgtgttgcatctacatatatatttacaaacacacctacgtacctatagtggtattgttaaaagtattttttaaatgtactcttttgctgtatagaaagaagaaagaataaaatgaagctcataaagggtttgataaataattatttcataattaaatgttacgcagtgctaaccaagttctttcttttgcacagggcattttggttgtgtatatcatgggactttgttggacaatgatggcaagaaaattcactgtgctgtgaaatccttgaacagtaagtggcattttatttaaccatggagtatacttttgtggtttgcaacctaataaatagcttataataaaacgttgatttacactttccccttgtggaaaaatcagctaccactgaaattatgggcctaatcctgaaaatttgttttgttctagacttttattgaactacttcccctgaaatgatccctcagagccctcattagtaagggggtaggagaaatgaggttcttggatgaactgagtatcatttaactataactatgtttggtttataatatttgttttgcaagtgacatttctggaaactattggaagcatgttggcacctacagtagtaatgactcattttacccagaggcattactataattattttttaaccacaacttccattaaaaagataaaaaatgaaataagacaaacaggagaaaactacgctggccaaaaattgaaaaatcataagtatggtaatacctcatttatccacatttttggagagtgaggcattccacatacatgaacttcctaaataaatgaaacctacccctttttaatgctggaacattacttaaaattttagctgttattgagaaaatctttttaagatgaaatgcatactctgtttaagggaatgcttccaaatacaaactaagtctttattggtgaccccaagccataattacagccataaattactatattacacaaacagtgtactccacatacatagtgttcctggctccgcctgtgttgacaggtctcacatgcttgcgttttctactcccatttctcattttctgcttgcaaattgcagcagcctgaaaaatgttaaccagctctactacaaactttatatgggacttaataagctttaagtgcacaaatgaaagattttcctgcaagatactttactgtcacaattatttcagtctttttaaaatataaatcaacatgctaagtagtgttctacatggttaattttgttggaagtctgaccatgagggaaataaatggacagtctttatgaaacctaagtataacctttgcactaagtttataggagacaaactggtggctggttggactctatcttgcaaaagtgggcataggtggtgactggaaggcacagtgcacggtggcatcattcactcagatgtgatgtaaaaagaacactctgcagtcaaaccctcaggacaagatgctaactgtgtggtttaccatttcattgctcttcctatctaaatttgacaaaagtattcactgttccataatgaagttaatgtctccaccactggatttctcaggaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcatgtaagttgactgccaagcttactaactggcaaactagctgtaagccagccatcccttcaaaataggcctgctctgagtctttaaaaagctagtagccaaagatgcacatttaaaatgttagcatcattcaaatgcacctcaaagtcttctatcctggtgggaaatagtgacacctggaagggtttcctggagcaatgattcttacttgctctgcaagcaaccttgctctaccttccctctgatagggacatttagtcatctttgcatgtctactatgtgccagaaactgtgcacagcacaggagaagtggaagcagagcaagcctcagcccatatggaatgttaactctacaaggcattgaaaaattaactccagatgcgttccttgctgttccttgtccttgccatccactctcacacctcaggaactttgcacttgtgctccctcagcctggaacactctccccgcaaatagccacgtatctcacttcctcatcttcttcagcttttggccgtaatgccatcttcaacataagccttccctaatctgtttaaaattgcaactgaccacccaccctcatggcttcagactcctcttccctgctctattttcccccatcacacttaactgtcatctgatacatgcatgaagctgcctgaagctgcccaatactatggccatgagccacatgtaaaaggaggctagttcgaactgaaatgtgctgtacggtgtagaatacatcccagattctgaatacttagtattaaaaaaaaaagaaggtgaaatatctcactagtagttgtttatattgattacatgctgaaatattttggattttgggggttgaaaaatacattgtgaaaattaatttcacctgtttctttttacttttgagtatggctactagaaaattttatattacatgtgtgtcttgctttatatttctattgaatagcactgtagtagataataaacaaataaacaatagctatatagatgtatatgtatgcatatatatgtacacacaccctcatcccattagaatggaagctcatgagggtaggatttttgtgtattttgttcactgctgtggctccaacacctaaaacagtgtttagcacatagactcgcagtaaataattgttgaatgaatcagctaagggttacaaaaaaaggttcttagcctcttgcaagtggtagatttttttcttgacatttatgccaggacctaaaagtcaccaggccaggaccagggagggtgggaataagaatctcaagaactgaattcatagaaggcctcaagctccgtctcggttcctgctctccaagtctctgtgggaggtaatgaagttgatcaaaagcaactttataaatatggggtcaaattatcagagaaaataagctctaggagagtaatgagatattactcagccaaaagaataaaacattccctggcagtgaacttttgcagataaggcgaattgaccttacaaagcacacagctgccctgacagaccccactttcccacttcaacttttgttattaccctgatggattaatgtggctggaggtgctaccttctctagggtactgttaccccaggattaaagcatgatagagatttcctgttatccagaacggaatagtgccatggccttttttaatccaaggagctgatactgagagcaaccacaaacccagatgtgtcttaaagagaaacctaaaaccaggaactggcctttctctatgctgtgtgcattgagtggggctacagcccttttgcagggtccccactgactacatcttgcactgacaaactcctcagtgactgttgaaggggaataccccattcctgattgccagccagtgacatcaccagacttgacagctgagtggtttggggtgatttctttctgagcctcctctattcactgtgcttctgatgttctaacatcttgggccttactaaccctggaggaactgtccctcccaaggctagctaattcctgcaaatagtaaacagcttgccttcaaagcatacctgtcatgtgcaaaccaaccaatccagagcccttatctaacctcctcctttatcaggctcttacactttgggctactatccacctgccctaatcaccccagggcccagttccagacaactagaactatcctcggagcctgctgaaatactccagattggccagctccaaacctgcttaccctgccttaccagtttcttcccagggaaactgcaatgaaggctcttgctcatgtttttcccctctctctctctgcctctagagcccagggcttcccccatgtgaccctgcatgacagggtgtgcctcctcctcttgcaaactgtgaatagcaaactatcttttcaatggcagttgtctcctgttctgttggcctcatcatacctggaaaataataaaactacattttaaaacacctccattttcccatctggaaaatggagcctgtaacacctgcctgacagaagtgtagaagtagctgtaatttatgaaaacaattagcctggtgtgttgcatacaataaatacttaacaaatggttgatctgtcaatggggcacactttttgttgttgttgttttgttttttgtttttggagacaaggtctctgtcacccaggctggagtgcagtggcacagtcatagtgcactgcagtatccaactcctgggctcaagcaatcctccttcctcagactcctaagcagctgggactataggtgcacaccaccacaccaggctaatttttttgtgggcggtggatgggagtaaagacaggatctcactgtgttgcccaggctgatctcaaactcctggcctcaagccatcctctcgccttggcctctcaaagttctgggattacaggcttgagccattaagaccaaactaatttttgagacaagataattttttataaataaatatttcagaattctaaggtcaaaattagaacagtagatgcttagtttatgcttttctaactctctttgactgcagaatccaactgtaaaagatcttattggctttggtcttcaagtagccaaaggcatgaaatatcttgcaagcaaaaagtttgtccacagagacttggctgcaagaaactgtatgtaagtatcagaatctctgtgccacaatccaaattaagtgacaaggaggaatctgtttcccactgttcaatgctagttaagctgttttctcttcttatgcaaaagtcctttatttctgttacaatcttaaatcgatgtgtaagccctggggatgtgggtgggactttcagactttatccaacagagaatttaaaaggattctccatagggggtcttaaacagctgttgtgtacttttgcttttctcagtccttccctccagtagctctcaatgttgtggtttcacactgcattagtgttggggagggagaatttgatcttcagcatttgacagtgaaaaggagagggctgggaacacaaataccaacatattgcaacttcccaagagtggatttgaagccagcctgcagaagccctaccaaaaatggtatttggcaatgaatatacaaagaactttatttgtgtctggctgcctggctatgtaatacaacagtcaacagtttgtaattgagttcatgttttcccttgcatagcactgattcatgacttatggtatgtgtgaatgaaaaagggtgtgctattaatttcctaccttggttttggtcactgtaacaacataaaagccagcttaaacagaggatgcatagccccagatagcggaaattgatttttgttgaacttcgctgtttttcttagatgctttactgtgtatcctagttctctattacctcagtggtgggatatatgagttttgtgtgctaacctagctcatttaagaatgaaaaagtaaagtatcagtcccctgtcatgctctcccataaaactgagtatcgctaatcagttgacaagcgaagattggtgattgcttgggtagttaattagcatacttcatttagcaaccaaagtaaacccacaggggagacagccttactactgcagatctacattaaagcaaaaaggactttcttatgccatacaattcatgatctctttcctcagcctgttgaattggcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttctcctcttttactttcatatccaactttttttgaagttttatcactacttaattttttaaaaaaattcaacaccaccaattccagttttcttcatatgtaaaaatggacttgtctgatacgtacacattgtatattttcataaattcactcatttgttcaaaaatatttgttgagtggggcaacataccagctccttaggaagcccagagctgaaccaggcatgaaccctgtcggccaagaactttggctcagaagggaagagatgagatggtcaacaatgactgtgacacaggtggcctggaatgggccctgattctcatagccccaggcgagcaagaattccacatcaagaaatctggaagctgtaactgaggcagtctagcagtgagggcatgatccctgggcctagctagtaaagtgccttcccttatctgcaaaggccatccttcttgcgcagaacaagctctcaaaaggcatgcacctgagtgctgaggctgggagaaatactcacctgggcagccagattcaccacattccccttccaccatatggagaagtggcatttgaattgggttaaaggacagcaggtttggagttgggcagctgggcaatggaaataccgatccaggtgtggcagaagagcaggaaagtataagcacctgtaaagttataaggaaacagtacttagttatttggcaagaacagaacacagagagggaagttatgagaataaatggagaaaaatatacttatactaggtcatagagttccttgaaaactgaactagagagtatggaatttattctctggtaatgtggaaacaaaaaagtaatcagattagactgcaatctttcatcattgtattagtccgttctcacactgctataaagaaatactgagcctgggtaacttataaaaagagatttaattggctcacagttctgcagactctacaggaagcatggctggagaggcctcagggagcttttacccatagcagaaggcaaaataggagcaggcattttacatggcaggagcaggaccaacggggctgtgggaagtgccatgcacttttaaacaaccagatctcctgagaactctatcacaagaacagcaccaaaggaagaaatctgcccccatgatccaatcacctccaaccacgcccctccctcagcattggggattacaattttacatgagagttgggtgggaacacagagtcaaaccatatcattccgccctagttcctcccaaatctcacgtccttctcacatttcaaaacacaatcatgccttcccaacagtcccccaaaatcttaactcattccaacatcagctaaaaagtccaagtccaaagtctcatctgagataaggcaagtcccttctgcctatgagcctgtaaaataaaaaaacaagttagttgcttacaagatacaacgggggtacaggcattgggtgaatgctcccattccaaacgggagaaattggccaaagcaaaggggctccaggccctacacaagtccgaggccctatgcaagtccaaaacccagcaaggcagttattaaatcttaaagctccaaaataatttttttgactccatgtctcatatccagggcacgctgatgcaagggatgggctcccaaggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcaggagcaggcatcttgcatggcaggagcaggaccaagtggggggagggggagcatcttatatggcaggagcaggaccaaggtggtgacaagctttcaccaaggggagaggtgccacacacttttaaacaaccagatctccgtagaattctatcacgagaacagcaccaaagggagaaatctacctccatgatgcagtcacctcccaccaggcctcagctcccacactggggattataattcaacatgagatttgaatggggacacaaatccaaaccatatcaatcattctccaagacaacttgaaaggagtagaagcaggaagatgaagtgagaagtggaacttgaaataagacacaatgagaatggaaaggaagagatgaaaggaggagcatctcagaggtagaatcagaagtatttaccaaggaattgataaaaagtcaaagattagcaaagatatatgctcatgcaataacacatatatgaagcacagaagcaaaagctggactcagaacaaaaatagcaagttgagccttaaacacactgagtttgccttgggagtagaatgtccaggcagagaagtccatcaggcaattgaaaatgtgaatctgcaacttgtaaaaaatgtattattcagcctgggctgtcatacaatagaccacagactggttggcttaaacaacaaaaatgtatttctaaccattctgaaggctagaagtccaagatcaggatgtcagcatggttgggctctattgagggctctcttcctggcctatagatggccaccttcttgctgtgtcctcacatggctaaaagaataagagtcagttctccagtatctcttcttagaagggcactaatcccagcatgaatgcccaccctcatgaccttgtctaaactgaattacctctaaatggccccatcattaaacattgtcacagtggggcttagagcttcaacatatgaatttccggggaacacaattcagtccatagcaggggtcaaggctgggaatatgcttttgagagtccaaaagcaattattcagtagtccaaaagcaattattcaactacatatataaagtgaaagagaaaagcagtgaggtaagggacccagaagcaaagaccaccatgaaagtcagagtaagagaaagtttcaaggagaaattggatgctcaacagagtccactgctactcagtacaccagaagggtcttggaagctgagtaacttgagtgatttggaggtctagagtgtgcttaggagcacaggtgttgaatggaatggagagtacacttattctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcaactgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagattctgaaagaggtgaaagaagtgggtgctagagagggagactggggacatgttagtgacagtggcaggtgaaggcaaaagatagggagaattaacccatcctccaagaacatactgttcattcagacttgagggttagtctgccattaagaagccagagccaacccttacaactcaataataagactgtcttagtcgttttgtgctgctataacacaataccacaaattgggggatttataatgaacagaaatgtatttggcccacagttctggaggccaggaagtccaagatcaaggggccacatgtgctgaaggtcttcttgctgtgtcataacatggtggaaggcatcacatgggtgtgagagagtgcaagagagagcaagaggtgaacagattctctaacaaacccccttccacaataatgaactgactcccaagataatgacattaattcacccatgagagtagagcctcatgacctaattacctcttaaagatccctcctctgaacactgttgcattgggaggggattaagtgtccaacacatgaactttgggggacacattcaaaccatagcaaaggcaatattactcaatttttttaagtaagcagaagatttgaatagacattttaccaaagagacgtaagaatagctagctaatgagcacatgaaatgaaacatatgcccacatgaagatttgtacatgaatgatcacagtagttttcttcataatagccaaaaaccagaagcaatcttaatgtccatcaacgggtgaatggataaaaaaaaaatgtggtgtgtccatacaatggactaaaccattcatcaacataaaggaattactgatgcctactacagcatgataaacctcagaaacattatgttaagtgaaaaaaaggcagataaaaaaattacatgttgaatggttccatttatatgaaatttctagaaagaggcagaactacagagtcagaaaacaaatcagtggttgcctggggccaagagaaggagtgaagataaaccacaaatggacatgagggaattttctggaatgttgagatgatctaaaactggactgtgatgatatgatagctgcacgtctatataaatttactaaacatcatttaatcactttaatttactaaacatcaccaatcacttaaaattggtgagttttatgatctataaattatacctcaacaaagctgatttataaaaaaagagcctgatgaaattttggatgtttagggcaagtgttgggattctaagcttcttgacagccacatacatgcaacaatacccccacctccccaacaaacacacacagacagcacagaggccaaggcttccaccatagccacagtcactcagatacttgactggaaatgtacatagatttctgcagataggatggtgctatttctttctcactctcatcgaaagacactattttgtgctacataaaggctgaacctgaataatctgtacataatgctgctttgggaaatggttactgattgcatggataaatttgcacagtgttttacttccaggacagcgcaatcttgaatgttgacatggaacatttccaaaagcatgcaatgagctatgtgtatgttgaaacctgcgaccaaaaacttgcctgcttgtagattgggttttctttctagaaaatgcccaaatggagtttggctaaaatctgaatactctttaagtccattcaaacaaaatcggagtgtcactacactggaaatcactcacaccctcctctgaacccttttgcaatgggtgttgtaattgtattatacgttgtttcacacttaatacaagttcttccattaaactgtgtattgacttccttgttctcagcccttatctgcctcatctttctgaagtgtttaacattattgtaaccctcatttttcttgaaatttcctcttcctttggtttctgggacactgaaacttccagttttcctcctgcttctaggttgttttctttatcctcaatggcttctcttccttctgtcttccttctctcagatgtagctgtctcccaggatttttgtctttaggggtcatcctccaccaacagttggaaccattcccatcaataaccacctttgattctctctacctggatgtcatcatcagtgtcacaaatttaccatgttcagaatcaaactctttcctgccaaaccctcaatttctcacctcctggctttgattaatggcatcaccattgtgtaatttacccactcctcattcttttcagtgttcggtttttcaggttttgacaaatgcatgcagttgtgtaaccaccaccccaacaatcaggacatagaacagttctatcatctcagaaaatttccttatgctcctttgtagtcaacctctaccctatccccaggacctggaaatcagaaaaccagatttattttctgtctctagagttttactttttctaaaatgtcatataaatggaatcatgcagtcagtagtcttatgagtctgtctccttttacttcgcatattacatttgagagccatccatgttgtcgtatcagtagtagtaacgtatcagtaattcattcctttcttattgtggcaaaaaaatacataaaatttaccatctgaacgatttttattttattttaagttccagggtacatgtgcaagatgtgcagatttgttacgtaggtaaacgtgtgccatggtggtttgctgcacctatcaacccatcacctgggtattaagctcggcatgcattagctgcttttcctgatgctcctcccctccctcgataggccccagtgtgtgttgttcccttccctgtgttcatgtgctctcattgttcagctcccacttagtgagaacttgcggtatttggttttctgttcctgcgttagtttgctaaggataacagcttccagcttcatccatgtccctgcaaaagacatgatcttgttcctttttatggctgcatacaaccatttttaaatacacagtacagtattgttaactatgtgaacattgttgtgcaatagattcctagaactttttcatcttagcaaaactgaaactctatatccattaaacaattctctctctcccccaggccctggcaaccacaattctactttgtctaagagtttgactacttcagatacctcatataagtggaatcatgcagtatttgtctttttaggaccgacttatttcatttagcaaaatattctcaagcttcatccatgttctagtatatgacaagatttccttctttttaaaggcagaataatattccattgtacatatatgccacattttctttatccattcatctgtcaatggacatttaggtttcttatacctcttggctattatgaatagtgccgcagtggccatggatgtaaaaattctctttgagatcctttttttcaattcttttgtatatacacacagagacaggattgctggatcatatggtaattttattttcaaatttttggggacctctctactgttttccacagcagagtagttcatctctttttatttttgagtagtattccatcgtacagatgtaccacattttatttatccattcaccagttaaagaacatttggggccaggagaggtggctcacgcctgtaatcccagcactttgggaggccgaggagggcagatcacttgatgttaggagttcgagaccagcctagccaacatggtaaaaccccatctccactaaaaatacaaaaaattagccgggagtggtggcacatgcctgtaatcccaactattcaggaggctgcggcgggacagttgcttgaaccctggatgcagaggttgcagtgagctgagatcatgccactgtactccagcctggatgacagagtgagacccgtctcaaaaataataataataaagaacatttgagttctttccattttcaggcaattacttatacataattgtaatggctatgacatttgcttgaaggtttttctgtgaacgtaatttttatttctcttgggtgaatatctaggtgtaagagtaactaactgggttgtaagataagtgtacattcaactttatgagaaactgccaactatttttcaaagtggctgtatcattttatgtccccaccagcgatccataagagttccagttgttcagcatcctctcccgcacttgacattgtcagctttctgattgttagtcattctaattggttgtagtgctgtctcattttctttttaatctttatttcccaatggctagtgatgtcgagcctcttttcatgagcttatttgccatccttatatcacctttagtaaagtgtctactcaaatcttttgcctatttttaagtatttattaataatattaatttagttagggtttattttattggcttgtttttgtttcttattgaattgttcgagttctctgtatattgtggatacaagcatatcttatgcgatacacttttgccaatgcatttttttttcttttgggacgaagtctcactctgtcacccagcctgaagtgcagtggtgcaatcttggctcactgctacctctgcttcttgggttcaagtgattcttttacctcagcctcgccagtagctgggattgcaggcatgagccaccatgcccagctaatttttgtatttttagtagagacagggtttcaccatgttggccaggctcctgacttcaagtgatccgcctgccttggcctcccaaagtgctgggatcacaggcatgagccaccggtgacacttggcccacaaatgcatttttctagtctgtggattaccttttcatttatttaatggtatccttcaaaaagcaaaagtttttgattttgttgaaaattttatcagtttaccaattgataaaactttatcaatttattttttttcttttatcaatcctggtgttgatgttgtatctccatgcatctactcttgaatgctcagatttgcctatcatccttccttgctcacttacctcagtagcaaccctgtctatcacttttcatagcttacaaccatctttcacatttaatcatttctttgatcatcaccttcagtaaagttaggccagatattctccagatgagcttattgctggtgctcaaatgctcaaaatggcttgaccaatgccatacagtaagcacggatgatagcgctctcatggcttgaaactaaaactgacttgtttcctaatgcacatgaattgtacacctccctcccctcacccccgaccccccctcaaccgacagacacacacacacacacacacacacacacacacacacacacacacaccagcttctctcttcttggtcatcatcctaatcagcatcacctcctctttcactgtccctcccctcaccctgctgtcagccccacaatgctttcaggggagtgtggagtgcagacaatacaatgctcttcctggaaaccttcttcctcttacctccctgtcccgtgagtcctccagctattttctgatacccagttattgcccacgtcctttaattccttggaaaattacccaactccatcccccttttatgtgactttgtctccagacaaatctacatgtagcgtagactgtcagatagggagacctgatcacagaactttggcttcctcatcctaaaataaaaccaattacatcacaggattgtaaccaagtacaatccattataaggattaaataagatgttttgtaaaggatataatgcctatgcatgaatcattatatgacaaatacactctttcactaccttaattccagagaaaagcctcataggcttccgtattgtaggtatgcaggagtgtccctcacctattcttattcagaaacctcctaactggcctccatattgtgaatcagcttctcctttctgttctaagcttggcgcttacagatgccatctccctgagcacaactcagaactcagccatgtcccattgatttcagtctaacgcactttctttttttttttttttgagacggagtctcactctatcgcccaagctggagtgcaggggcgcgatctcagctcactgcaacttccacctcccaggttcaagcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctccacagcacagtcccatttcaatcttatgggtccctaatcccttcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctgggcaaaagagcgaaactccatctcaaaaaataaaaaaggaaagaaagaacacatgtgtactgttactcctggccccaccccctccacccaaaactctccctctgccctcatattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattgtcctgtgtggcagttatctgctcaattctcttaaccctgttcattcagccctgggacctatctagtaacttgaacagtaacctactcgtatgtgatcaagggtcaattgatacttgttaaattgattttaaatgttaatgcatattctgggacttgaaagttaacacgatgatgttgtcagaagtgattgttgattgttaagattttcagactttgaaaacttctactttgcaaagctgaattagacagcaaagttctgtagctccctcctggcaaggggtttgagttttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctccttcttgctgggtactgcaagctacacttgcctctcagttttatgtcttcctactccagctgtctggtgtggattttccttctgctccaagcttccttcatttcttcctccttatgcttcctactcttagagtggcctggaagtgttgctgggccagaactgcccccctgggtcctgtccacaggggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacggctattttatatgaatctagtactttcacatcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcgggagagaattttggaagagatattctaccaactacagatggaatcttcatcatcatgtagacttcagatattcttttagaaaactttacatttacttataatctaaaccttacttgtttaaacaagtcatgaaatgtatagcttaataattgcctttaagaaaattgttgcccaaaacagaaaccgtattgagtatgtaaagccaagtttagttaccaagacctactgatttcctttcatatatgtatggtcacatctctcacctcatctgtcctgtttcttgttttactagtggtcctttggcgtgctcctctgggagctgatgacaagaggagccccaccttatcctgacgtaaacacctttgatataactgtttacttgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgt

SEQ ID NO: 37534 - DNA, 12740 bp, Homo sapiens; identical to SEQ ID NO: 37412

SEQ ID NO: 37535 - DNA, 21319 bp, Homo sapiens
ggaggtgggaagtatcccgggctgggggtgggggtacgccgcacagctccagtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggtgagaggctgggaagggaaggcgggtcccggtagagaagaggctcggtcagggtgagggctgaggagatagagcgcctcccgggccccgcccggcactgcttggcgtggggcggtgggattcttcccacccgagagctcagagagggtgcgtcgggccagcttcacgcctgcccccgcatttgaaggacgcagagctggggtgggggtggggggcgcacacggatttgtcctccgcctcgctcaagggggcgacctgggctgcagttaggttgtcgcctgcaggaggtgtgctgttgagggagaggaaaaccgtccgaggagaggtgatgagggggcggtgatggctgtttgtatcttttctgttaaagggctagggaatgctgctttcttctactccctctccctcccccaccttagcaataggagacgggagagaagccttgctgtggttacaccccctcccccatcatagggcaggggtgcgtaggggggttgggggttagccaacagggcaggctgctggggcaccacatgggcgctattgtggtagaggttgcgctttcgagtctagggaaccgcaggttgggaagagggcagcaagtggggagagggtggagaggaggcaggagaaggaggagggggatctgatcttcctgggagaagagaggtggggccttcctccccaggcggagcgggggcggtctcacaggaggagggagcatcttgtcactggccctcagtttgtgtcttccaatccgctttctttctttaggaagtaccaggattcccggaacagaaaatggagccattgcttacgcgaatcgtttgagggaaggggcgggagttggggaggtggagttccctgttaaaacgggccacttgattagcaaagtggtagctgttattttgggggaattcccgtcttgattgcattaaggcgggtctccatctttccaggccaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggtaggtagtaacagtctttgctgctattttgtcttgggcttgttgttggggtaggtgtttccacttgccgtgacttgggacatgggacagtgttatgggacagtggattatcatagcccattggacttgagtttgaaaaacatgtctgtaaaagttcattctaagaaagaaactaatccattaaggttcagcttttcaccgaatgaatgattgaccttggattcagccaggaaaggctcccatgtatcacatattcacatgcgtcctgtttcccagcatagaattattaccttgcatagttagaatttttatagttgtctatcttgcttttccaaagagactagacgcttttcgactgcaggaactggatttcgtctcctcttccacaatgcccatgcaaacagtaggtacccatgatgaatttagaatgtaaatagatagaactcaacaagctttctaactgtagtttaaggaaagggcaagagatggcttggctgtcagcagaagtgcctggaaatagcttagcaagggtacaaagacccttagcctttgtaattaagaagtttttgtgtctctgccttcctaagaggcacagaataggcatagataatggaaacttaagacccaaaaagaaaaatattactagaacacagagtcattatctgcagtcccagatttcctgcttccccattgtgggcaaaggggtctctccatcagacctaagtctttcaaagtgttatatatgaattgggatcctggagagtttggaggagggaccaatatatgtatatgtgtggtgtcaggtacagaattggtaccagtgaatggtagctgctattattatactgaatgcaagtataaaggagagcagactggaaagagtggaagtgagtgaaatactaagtgcacaaagagtcatattgtagtgtgtgttcaccctactcttttacactagagtcataataagaggaagtggactcaggatagagggtgggatttattggttagaaggaggaacttctttaaaaccaggttggttaaagttgagtatgtaactgaaggaaattgtagaatctgcttccctatatacctttatttttatccacccaggctggagggcagtggtgtgatcataactcactgcagcctcgagctggcctcaagccatcctgtacttcagcttctcaagtagctgggaccacatgcgtgtgccaccatgcccagcgaatttttttttttactttttgtagagatctcactgtgttgctagggctggtctcaaactcctggctccaatatatcctcccaccttggcctcccaaagtgctgagattacaggcatgaaccaccatgcctgaactctcctcaccatttttgttgaggtaaatttagaggcagaatggtatagtaattaagagtggatcttggaatcagacaaaattagattcaaatcctgcttctgctaattaccagttgcatgtttcttgtaaaattgcttgtcttctctctttattttcttcatctgtaaagaaggtaatgacatatggttttcaagagaattattatttttttggttgtcagtagaattaaatgagataaatgtaaagcacctggtattgtacaaagcatatagtaagtaccaaataactgttagctgctattaataatccattatcataatcctaataatatgaacactcagggctgccttagaggaaaagaggtttacagaagaacaacttgctgcctgaggtgcttgtgtagagggatgattgttaccatgagtttctgtgctggtcgtaggcttatgagcagcgaaatcttttttcagcttcagcatcagcatcgcagagacagctcctgctgcctgagtgggaggtgaagctggagcaaggcaggggccctgaaccatcaatttggatgtagggtgaagatatgggggcacaagaatagtattcatattagaaaagtcagtgtgactctgagataatggttcactcttccagaaaagagcaccctgatgacctaggtcagggatttagattcctagatgcccttattttaggtctcagtcagtatatggggatcttcatttagtccactcttttcatttagtccaatcttaataaaaaatgtctgcttttgagtatctgtttcagaatatcatggcctagaaattgtgatatctgtagaattatctgtctaccgtaccttcttcacttgaacatctgttgcaaatatagatagagtgctaataaaactatttgataatgaaaagacatgaggagcgtttggaaagggtcccacagatgtttgaaggtttcatattatagtctggtaaagaactgactaaagtagggatttcatgaatgtgttagagctttaccatggacttatgcaaaggatctgccacaccatgtggaccagaaaggaaatggctcagaatgttagagatccaccattattaccatattcctgaagaaagttgagatgactgggtgtggcaggtctcttggtaccttttagttctcccattactgctgaaagcctggcataatccttcctttattagcttatgcacaggagtgtcaagcgtgaatgcttaaacttcagcatgagcttaagatgtaggagagcatttgctctctgttgcaatggtttatgtcctttttttaaaaaaaaaatagtcaaaccttaaataaaattttatttgaattctaatacataaaatggacaaaagtggagttactctctactggtggtggaaaatgggggtggggtataattacagcccctcacatgatctctcctctcttcaagcagaacctgtgggctctgaggacatggaaaccatttcttcagtttgtcagatacagggaaaaggatcagagaccacctatagaatacagtcttcttcaaccccacaagtgttttgccaccctcagtagaaccgttctcaacacgcctgtcagtcactagctataggtcagtcattggtgctggatgctggagacgtgaaatatgaataaggcatagtctgtgctggcaaagagctcacagtctagtgaggtactttccagcctttttctcatcatggtatacacaaaaaatggtaatagtgagacttgaaatctgagatggctggcccaagggctgtagccaccccaagccctgcccagccatccagtggctgataggatcagtatctccagctgacctgtaatgcactagaggcacattgggcagttgcagctctggaaagcaaaacagacaaacgtgaatactgcagcaagtcctagagtagaagtgtgtttgggatgccgagggatcgcaggtaactcttattccctaagtaggcagttctctgttcctctgtgtccttaggctgctctgtataatggttggccttgtccacatcatgtcttcctgtttaagcagtttactgtcagctccatcttgacttgcacaatgggaccagattaggggcagaagattattaggagtctaggctattgatggactttcagtgattttgtgattaggaatttatagtgttctggatatccaagactgtagaggtgggcattggattggtacagccatagaatatcaggagctgtagtggttgtaagctggtcagattctaagaacaaggcaagctgtaatttttgggcagagggcagtaccacagaatgttccaaagaaacaaatgagtctagtttttatcttgtcactgttttatctgactaggattctaaaacagaccttgtcatcttttctgactcacttgctaagggttgtctgtggtaaaagccagacccttcccaggcgttttgggtctccatcagacagggcggttcgggatccttcttcacttcacagctgtggcgtccttcaggtttgcgtgtcctggagtcttttccaggattgttctttgcctagatgggaagctggcataacaattctggcctgagcctaaacaccactaattgagctaataggaacttatttagttaggtacgttttagtttacaccaaaactctagctttggatcctccctcttttcttttgtatgttctatccccattggtgtctatgatgtcttgctctcttgatttcccttctgcctctctggttgcttcttattctttcctggcctgcttttctgcccgctattttatttatttatttatttattttaattagtttttttttttgagacggagtttcgctcttgttgcccagcctggagtgcaatggcacgatcttggctcacagcagcctccacctcgcaggttcaaaccattctcctgcctcagcttatggagtagctgggattacaggcgtgcgccaccacgcctggctaatttagtacttttagtagagacagggtttctccatgttggttaggctggtctcgaactcccgatctcaggtgacccgcccgccttggccttccaatgtgctgggattataggcatgagccaccgcgcccggcctatttattatttatttatttatttatttatttttgtgatggagttgcgttcttgtcaccgaggctggagtgcaatggtgcaatctcagctcgctgcaaccttcgtccaccacctggcttcaagcagtcctccagtcttgcctcctgagtagccgggattacaggaatgccccaccatgcccagctaattttgtatttttagtagagatggggtctcaccatgttggccaggctggtctcaaacccctgacctcaggtgatccgcccaccttggcctcccaaagtgctgggattatagctatgagccaccgcgcctggctcccactactttaaatgttgaaatgtcaggcaggtttctgcctttgcccttttcttctatcccactgtgtacactatccctagatatatcagttaggatgtattagttgcaaaaatagaaaacacacgtgtctaaaacgctgagaggatttattaaatcatatagcaagacatctagtagaaaggcagacataggccgggtgcagtggctcacgcctgtaatcccagcactttgagaggctgaggcaggtggatcacttgaggtcaggagttcgagaccagcctgaccaacatggtgagaccctgtctctactaaatacaaaaaattagccgggcgtggtggcaggtgcctgtaatcgcccagctacttgagaggctgaggcaggagaatcggttgaacccaggagatggaggttgcagtgagccgagattgcgccattgcactctagcctgggcaacaagagcaaaaactccgtctcaaaaaaaaaacaaaaaggcagacacagaagaacacatattgtacaattttacttctatgaagtacctagagtaacagattcatagagacaggagaatggtggttgccaggggctggagggacagggggattggggatcctctgtttaacaggtacagtttcagtttgggaagattaaaaagttgaggtgatgaatagttgtgatagttacactacagtgtgaatgtacttaacgctactgaattgtatacttaaaaaaatggttagaatggtaaattttgtgtatattttactatgatttaaaaaaaaagaagccagtcgggtacagtggctcatgcctgtaatcccagaactttgggaagccgaggtgggcggatcacttgagcccaggagtttgagactagcctgggcaacatggcgaaacttcagttaaacaaaaattagccaggcgtggtggtgcatgcctgtagtcccagctactccagaggctgaagtgggaggattgctcgagcctgggaggtggaggctgcagtgagccactatcacgccactgcactccagcttgggtgacagagcaagacccatctcagaaaacgaaagatgccaggcgtggtggtgcatgcctatagtcccagttactcaggattgcgtgagcccaagaatttgaggctgtagcgcaccatgagggcacctgtgaatagccattgtatttcatcgtgggcaacatagtgggaccccatctctaaaaaagaaaaagtttagtttaccagcttgatactgtaattaaggacccaactgagtttttcccatttttctgctctgacatcctggagtttttaatgtctgtctccctctctttatggtctccagattattctagcttctcatccttctacatcatcaacatccaaaggctggacaagagaacattgccataggtccttttctaagattgaggggccaggcacaatggctcatgcctgtcatctcagtactttgggaggctgaggtgggaggactgcttgaggtcaggagttcgagaccagcctgggtaacatagcaagaccttgtctctacaaaaaaactttaaaaattagccaggcatggtgatgcacacctgtagttctagctacttgggaggttgaggtgggaggatctcttgagcccaggagatggaggctgcagtgagccatgatcatgccactgcactctagtctgagtggtagagtgagactctgtttctaaaaacaacagtaataataaaaacaaacatgttcaggccaggtgcagtggctcatgcctgtaatcccagcactttgggaggccgaggtgggtggatcatgaggtcaagagatcgagaccattctggccaacatggtgaaaccccgtctctactaaaaatacaaaaaattagctgggtgtagtggcgggcgcctgtagtcccagctactcgggaggctgaggcaggagaatggtgtgaacccgggaggcagagcttgcagtgagccgagatcgcgccactgcactgcaacccgggcgacagagcgagactctgtctcagacaacaacaacaacaaacaaacaaacatacatattcaccttcagatctgttcctcttgtattttctttctgaagaaatgccacccagccctaggccagaaacctgggaatcatctttgattattctactcttctgcgtacatttaagcactcattaaatcctgtggattctaccattttgatgtttcaaatctgtcctcttctctctatctccacttgtagttgacaacttgcgatttctcacctgtattactatacctcctaagcagtgtctgtgcctccagtctttcccctttctaatttactcctgaaacttctaaagcacatacctgatcacgttactcagcatggcctttaaagcccttcatgatccagtccctgcttatctctccagccccatccctcatcattttctttctttcttttttttttgagaccgagtctcactctgtcacctaagctggagtgcagtgatgtgatcttggctcactgcaacccctgcttcctgggttcaagcaattctcctgcctcagcaccctgagtagctgggattgcaggcccacaccatcacacccggctaatttttctatttttagtagagacggggttttaccatgttggccaggctgatcttgatcttctgaccttgtgatccgcccacctcggcctcccaaagtgctgggattacaggcgtgagctaccacaccttgcctgtactcttcactttaggaggctgagactggaggatcgtttgaagtcagaagttcgagaccaacctggtcaacaaagtgagactctatctctaccaaaaataaaaataaaaaagttagctgcgtcacgatgatttgggcccgtaggtctttttagctactggggaagctgaggcagtaggattgtttgagcccaggatttggatgctgcagtgagcctgggtgacagagtgagacctcatctctttaaaaaaaaaaaaaagattatataaatttttttaaagtgctatctgaaacttaggtctttttttctttttcttttttttgagacatattctctcactctgtcacctgggctggagtgcagtggcgtgatcatggctcactgcagccacaacttcctgggctcaggtgattctcttgtctcagcctcctgagtagttgggactacaggcgtgcaccaccacacccagcttttttttttttttttgtagcgatgggcttttgccatgttgcccaggctggccttgaactcctggcctcaggcaatcttcttgcatcagcctcccaaagtgctgggattacaggtgtgtcctgctgtgcctggctcagtctttatgcctttgcacacacttcccctgcccaactccctctttattgtctgattacttcctcgtcttcctttaggagccagctcaggtatgacctgagaattaggtttcagaatcaccctttacccttcagtgttgatttactgctccagctttctgttcacataatactatgtgctttactcttactctcacactgttttgtagtcctgtcttcactagtcttttccattaaagactgagtttcatgaaggcagaaactgtctccctctctgtatccctagttcagtatgcccaataaatgtttgatgaatgaggccaggcacggtggcccacgcctgtaatcccagcactttggggggcagaggtgggcagatcacaaggtcaggagatcaagaccatcctggttaacatggtgaaatcctgtctctactaaaaatgcaaaaaattagccaggtgtggtggcatgcgcctgtagtcccatctactcgggaggctgaggcaggagaatcgcttgaacttgggaggcggaggttgcagtgagccgagattgcgccactgcaccccagcctgggcgagagagcgagattgtctcaaaaaaaaaaaaaaaaaaaaagtttgatgaatggatgaaagctggtatcagaagctatttcttaactttgggaaatctttaagtctagtcgaaatagttcagatatcatctaggagttcttatgttctgatttcagtgctcttgagacaaaaacttggagtttacacaggtcacgagccagctgcaccaagaaaactcagtacgggcgtactctgcttttgtttctttaaattgtattggtctgtttggttagctgtgctaaaaatagcatctcttagtgatatttcaatttgaaaattatctaagaacaaagctgtttttactgcactctgcctggcagcagagggtttgggagaccctggtcttccttcccctggacgctgaagaggaggaggtagtgccagatcaggagtcccctcagaggtgtctcatagcacattcttggatcattcactggaatcaggtagagggagtatgtgtggccgactgggatgtgtgactctcaaaagcacctggagattgaggcaggcacgttcctgcaacatatgtaaggaaagatggctgagtagccagttacagcaacagcctgcttctcctggggggatgaggtgggagcagtgagttgtcctcaagtgaggatatccttagatgaggcttaaatcaactgatgtgcttaactgaattcctacagtgtcccacacagattgtactagagcacatatttgggttcctattgttatttttacctgtgataataaagtttctgactgtaaaacagaacctgcagatatctttttaacagagatgttagtatattccatttttcatcttgagccactcactttcagtcttaactgcttattcttggtatccaacagccaatggaaccctggcattttgccctataaacacaggagtaccatctgtggtgaaagagagtaactataggctatataatacatggagaaacaattcatggtttgtttgctttgccattctgcttcctagtgcttttttaggaatgtattgtgaaagtgagaataggctgtatagccagagatttgtattcatggcacaaagcagaaagctgctaccatcttggtggtagggcagcatgctctctggtattagcaagggacagggaaaaccaagacaagaaagccagcatcccctttgaaatgctcatttaagtcaagctccagattatacttaaagaaaagtcatggccagacgtggtgggtcgtgcctgtaatcccagcacttcaggaggccaaggcaggtggattgcttgaggccaggagtttgagaccagcctggccagcatggcaaaaccccgtctctactaaaaatataaaaattagcaaggcatggtggcacatgcctgtaatcccagctactcgggaggctgaggcacaagaatcacttgaacttgggaggcagaagttgcagtgagcaacctctgcctctgcactccagcctgggtgacagagcgagactgtctcaaaaaaaataaataaataaagaggaggagtcataacatccattagtttcaaggtcctgggctgtgccagggagatacatgatagctactggatatttattttttgagatggagtctcagtgttacacaggctggagtgcagtggcgtgatctcggctcactgcaacctctgcttcctgggttcaagcgattctcctgcctgagcctctggagtagctggtgctacaagcatgtaccaccacgcccagctaatttttttttttgagacagagtcttgctgttgtctgcccgggctggagtgtgatggcatgatatcgactcgctgcaacctccacctcccaggttccagcaattctcctgcctcagcctcccgagtagccaccacacccggctaatttttttgtatttttagcagagacagggtttcactgtattagccaggatggtctcgatctcctgacctcgtgttccgcccgccttggcctcccagagtgctgggattacaggtgtgagccaccgcacccggccaatttttgggtttttaatagagacggggtttcaccatgttggccaggctggtctcgaactcctgacctcaggtgatccacccacctcagcctcccaaagtgctgggattacaggcgtgagccactgtgcccggccttttttttttttttttttttttaagacagagtcttcctctgtcaaccaggctggagtgccagcggcatgatctcagctcactgtaacctctgcctcctggattccagcggttctcctgcctcggcttcctgagtacaggcgcgcaccaccatgcccagctaatttttatatttttaatagagatggggcttcaccatgttggccaggctggtgtcaaactcccagcctcaggtgatacgcccacctcagcctcccaaagtgctgggattacaggcatgagccaccatgcctggccagctatttagatattttatcagttattcatcagtcccactgtatattaaatggcaagagagaatcccaccaattctagtcttctagtccttttatgttgttcccaaaccagtcctgcgtcaaatatgtgtggaaaatggctgagaatggacaggatagctaagcaactcgctgtgcattacacagagataccaaatcctactggacagaagaaataatataaggacatcctcagatgaggcttaaatcagccaatgtgcttaattgaactcccacaatctacttggcactagagggaggacagattcaaaataagtagacatagtctttgcacatagggaatacacagcttaacgtgggaagcagtaaatacacagacttataaaagaagaaaaactcgacaaggtagtaagtgccacattgagtggttaaggtcattcaaagtaaggccttgatgtggcatgccaggaaataataggtgtaacactgggatcagcttttgaaccaggacttcagcatgacagccgagcaaagaagcaaatcaaaggacagtgtacctgtgttctggggcaaggcatattggctagttatatctttttcagccaccactatactcacagttggtaagcatttaatcagcaatagtttcagtcataaaggacagcaagataaatgtgtggcataaatttaattcagaatctgggccaaagcctgataccaaacctttaaagcaaagtgtcatctggagctgaaggaaaggctgcctgagcaagaggcagaataaaggctagaagactaggaagacttgggaaaggtttaaatttcatgaggtgttagtagtatgaccaaaagtcactactacaaattgccaaggttggtgagagctgttcttagctgggtaggtcgctcaggggtcctcaggagtctgtccacctgggtgggttgaggcaggaagagtagggaggaaggctagcgggtggcttgactgaagttgaaccctaaggttgagctagcccttcttcctggtgtgtgaaccctctaggtcaggggtagggctcatctggggaacctactgagagtgccacgcctggctcattagtggctgtctggggaggccttttgaagatgaaacacttcataagcactcattgtttctgttttttcggacaaactagtactttggtcttcagggactgttgatctggctcagttgcactagtctggaatttgctgcaaactgagaagggtggtgggggaaatgtcagaagtttttgtaaaaacaaccaaactcccaccaaacccccatgcgttagcttgtaaataggattcctccccgtccacctttcacattcttgggtttgggcgcactttgtcttgacctgtccctttggctgctgagtttggggtgtgtgtgtgtctctggttcccagactctagagaatgccagcagctggcatatggtgattgctgaataagctgcccgctgacacatgcctcctgcaggcacagagaactggtttgtatgggtgattctgaatcctcattttattattgtttcaaagatgcatttctgtggctatcctgtgccatagagaagagagggaagaagaaagggaatgaatgaatgaatctgattctgtctgttggggcaatggctggggtgagcagatagacattttataccttcataatgattcttttggtcctgttcatcctttcagcaggtatttgttgttgttattactattattattattattttgagatggattctcgccctgtcacccaggctggagcgcagtggcgtgatctcggctcactgcaacctccaccttccaggttcaagtgattctcctgcctcaacgttccgagtagctgggactacaggagtgtgccaccatgcccggctagtttttgtatttttagtagagatggggttttaccatgttggctaggctgttctcaaactcctgacctcaggtgatccacccgcctgggcctcccaaagtgctgggattacaggcgtgagccactgcgctcggcctcagcaggtatttgttatgtgcctaccatatgccaggcatagcatccagtctgagtgagctttcagtaaagtcagtagagaccctggggattagttcagtttttgaagtactgtgtgctaggcactattcttggtactggagacagagcagtgaacaaaacacataaggagctgatatcttaggcagaataaaacaatcagcaagaaataaatatataatgtatcagatggtgataaatgttgtgaagaaaagtaaagtgggataaatggggtagggagtggtgtgtgtctgtgtgtgtgtgttatacatgtggttgtgggaggcctctttggtaggtgacattgaaacagacaactaactgaaggaggtgaaggagtaatctatgatggttatctggaagagaagcattccaggcagaggtgatagcaaatatgaaagctttgggccaggcatggtggctcatgcttgtaatcccagtgccctgggaggctaaggcaggaggattgcttgaacccaggagtttgggaccagcctgggcaacacggtaagacctcgcctctttaaaaaaaaaaaaaaaaagctttgaggcaggaaaggaaagtgttggggaattggagtggagtaagcaaagagagagtagtagatctcatgagagaagtaggggagtgtaggtcttgtaggaccttgtaagccatggtttgggccttgggttttactgaaaaggagctatgaagccacgagtgggttttgaacaaaggactcatatgacctgagtttggttttaaaaccaccctagatgctatatggagaataggccgaaaggcttagggaagaagcagagaaccaatgagatgactgcctcattgcagcgaccatgtgggacagccccctccttggatgggccacagtaagccaaggatgcacctagctgaggagtaaaggggtagccccgccataccccacctctctactgccagtgcactgttgtttgaacagggcacaacattagcagctggcattccacagagtgtaaaggatcggcttcttttaagagtgcggctttcttattcctcctttattttggtgtggaagaaagatggagttgcaaaaatataggaagggaagaggcagagtctcttgattaaaggagaaagcataaaccttgggaaactggcaagcctgaaccttgtcaggagtcacagagagccactccttattccgctccctcctctcccacccttgccagaagtctcagggtaagtaaggttaggggagggaggggcattaatgatcttacaatgcctttgggtatagggtagaatgtcagaactgaagggacttcagaaatcatctagttcaatcccccttccatttacaggtgcagatatggaaaagtgaagtaacttgcccagagtcacatggttagattactggcagagcagggatccttagtgtttactgctttgtctctgttcccaaagactcagtatgtatctgagtgggccttggtatttatagtcccctcaggctctccgtttgtcatgaatgaactctagccatgaccttgggaaattctatttacttggaagtcctgacaagcaaatgatggtatgattttacatttcctttgtctaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattggtaagagcacagcttggatgtgggctttcacgccggcagctgaggcagggcagggacctattcctggttccccaacctggcctcttctccccaggcaagtccatacaatttgtggggttcagaaaagagggtggtgttgtttagcttactaccaggtgctgaggctgctgtttgcccacctaacctggctctccctgatgcgggaacttccatggcctggcactcaacagctgccctcaggcacggagttggtttcttctctgtgttgtttggaaagcaggtaaaaggctttgatgttcctgccaaaggcttggaattacttgggtttagatctttggtggccaatcttggttacagtttgctgaagggaggtctccctacatttgctatgtagatgggggctccagtcagcattgtcagctggctctgcctttggggctccaggatgccagcttacttccctttcttcactctgcctctcaggccccacatcttagctgaggccgactctggtagccaaagtaccagagcagggctgagtcattttgtaggagggagcaccaaagactgagtggaaaagtcaggaaagttggcccacgttacccaggcaactgtgaacctctcaaccaacttcctcatcctctttgacttctcttaggttttcattttggccttcaggctgctagcttaacgattatcaggtctgaggaagccttagcttttgttccattgttggtgttatggccaccactgggggaaagcagaaccaaactcattgtggtggtgtttgcggggctagtgtttgaggccaagtggccattgcctgttttttttccaaagggttcaatgtggagacagtggagtataagaacatcagctttacagtgtgggatgtgggtggccaggacaagattcgacccctctggagacactacttccagaacacccaaggtatgctcaggcctagcgtgggttggttgggtatgagcagagagtgtggctgtctttgttaatgggtggccaactgttaccctgctgcagctcctgggggcagaagaaagggaggaaagggagcaaatatttggagggtgtcaggcaggtgtggtcttttggttggggggagggggttacctgtcatcttagtgcagcccatgctctgccttcctagggttgatatttgtggtcgacagcaatgatcgggagcgagtaaatgaggcccgggaagagctgatgagaatgctggcggaggacgagctccgggatgctgtactccttgtctttgcaaacaaacaggtgagacttcttcccacccctgaatttgggagacagcaaactggctgtggaaattgttggctcttgggcctattatatggttaacccttttagtatgctctcaatgttagaagcgtgggaaactgagcacttggcttctttatgcccctcttcttgtgccccaccccaagctttatttagcaacatttcagtcctcaggaattgtctcaaatctttctttcatcttgcctgttatctactttaggagaattggcctcactcctgctgtcagacagacctgattctttggtcagtctgaatcacgtctcttgcttccccaccatcctcgtatttggtttccaattcttcagtacagtgacctctagtgctttggatcttgagttctaggtgactaaatccaaagtagctccttaggatcttgttctgggtttcctaaaataaaggaggaggggaaggtgctggtacacatttctttggtagatgggtgttctagaagcctttaaaaaatcctgaggcttctttttatgtgtctcccacgtgctccaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 37536 - DNA, 79542 bp, Homo sapiens; identical to SEQ ID NO: 35892

SEQ ID NO: 37537 - DNA, 28242 bp, Homo sapiens; identical to SEQ ID NO: 37305

SEQ ID NO: 37538 - DNA, 5060 bp, Homo sapiens
gctcgtccgctccctcccccgcgccgtgcacgtcttggttcgggccgggcataaaaggcttcgcggcccagggctcacttggcgctgagaacgcgggtccacgcgtgtgatcgtccgtgcgtctagcctttgcccacgcaggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcaggcctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaaggtgagcgccgcccggagggggcccaggtagaagcggggccgtgcatgagagaagctgggccctaactcctctgtgtccctcctccccagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttgacaactagttgcctggtatatagagttgcagatgcaactcagatgcaactctatctactctatgtacttagttcccaggagggaggctgtgctgccctatttcatgaagatggaaactccagttcaccgaagtgaagggctgtaccccatgacacagctagaggaggatggggactcttaacacaggctctctgctgggtgatgctgcaagttacaagtacatgtgaagccacttagctggagctgtgcctctcaaactcagtcttcccagccatggggatacagtccttgcacccaacccagggtggggtgggtgaggctcccagcggcctactctaaagccccttatctccggcctccagtgcttatcacattgggcccacagggtgaggaccctgctgtgccaggcatcctgaggccccaactctgtctcccctactcccaggatcaacaccccccggaaagagggaggcttgggccccctgaacatccccctgcttgctgacgtgaccagacgcttgtctgaggattacggcgtgctgaaaacagatgagggcattgcctacaggtactgtgggaccctcagcccggctcagggagcgccctgccccccattcctgtgatgctgggaccactcctgtacaatgtcttctctgcccccagccctgtggctagcagcgggtggttggtagtcccttccttgtctctggcagtgggagctatcagctcctcactgggaaccctgatgtcttcaggggcctctttatcatcgatggcaagggtgtccttcgccagatcactgttaatgatttgcctgtgggacgctccgtggatgaggctctgcggctggtccaggccttccagtacacagacgagcatggggaaggtgagcagatacacacatgacacatgggtacatactgagcgcctccgtcactcatgcaaacattcactgcctgtcctcttacctgtccagatgggtgttagggccccaaagaagattcagctcagggctttgtctgcaggatgtttctaatgtggtaggagacaaataacgcctgacattcaaccaaggtggacaaaggggccgggctcagtggctcacggttgtattgccagcactttgggaagctgtggcaggtggatcacctgaggtcaggagttcgagaccagcctgaccaacatggtgaaaccccgtctctacgaagaacacaaaaaattagctggccgtggtggtgcacacttgtaatcccagctacttgagagactgaggcaggagttcgcttgaacccaggaggcagaggttgcagtgagctgagatcgcaccgttgtactccagcttgggcaacagagcaaaactcagtctcaaaaaaaaaaaaaattagcttggtttgtgaagcatgcctatagtcccagctactcaagaggctgaggctggaggatcacttgagcctgggaggtcaaggctgcagtaagctgtgatcgcaccactgcactccagcctgggtgacacagcaagaccctgtctcaaaaaaacaaacaaacaggccgagcgcggtggctcacgcctgtaatcccagcactttgggaggccgaggcgggcagatcatgaggtcaggagtttgagaccagcctggccaacatagtgaaaccgcgtctctgctaaaaatacaaaaaaattagctgggtgcggtggcaggtgcctgtaatcccagctacttgggaggctgaggcaggagactcccttgaacccgggaggaggttgcagtaagccgagatcacaccactgcactccagcctgggcgccagtgtgagactccatctcaaaaacaacaacaacaaaaaaacctgtaggggtggggcagagggacaaagatgggactaaaggagccaaaaagacaggaagatgctgtgtctcatgcctgtagatgctgtgtctcatgcctgtagttccacctactctggagagtgaggcagaagattgcttaggcccaggaatttgagtcgagcctaggcaacatagcaataccccatctctttttttttttttttaagagatggggtattggttaaaaaaaaaaaaaaaaaaaaagaggccagatgcagtggctcacacctgtaatcccagcattttgggaggcctaggtgggtggatcacctgaggtcgggagttcgagacaagcttgaccgacatggagaaacccagtctctactaaaaatacaaaattagcccagcctggtggtgcatgcctgtaatcccagctacttgggaggctgaggcaagagaatcgtttgaagctgagaggcggaggttgcagtgagctgagatcgtgccattgcactccagcctgggcaacgagtgaagcgaaactccgtctcaaaaaataaaaaaaaaaaagaggccgggcacggtggctcatgcctgtaatcccaccactttgggaggctgaggcgggcggatcaagaggtcaggagatcgagaccatcctagctaacgcggtgaaaccctgtctctactaaaaatacaaaaaaattagtcgggcgtggtggcgggcgcctgtagtcccagctactctggcggctgaggtaggagaatggcgtgaacctgggaggcggagcttgcagtgagcagagatcgtgccactgcactccagcctgggcaacagagcaagactccatcttaaaaaaaaagaaaagaaaaaaagaagaaaaaggagagctgggtggcaaaaagaaattgaagaattaagagtaggaaaaacaccagctagaaaatactgaacttggccaggtgtagtggctcacgcctgtaatcctagcattttgggaggccaaggtgggtggatcacctgaagtcaggagttcgagatcagcctgaccaatatggtgaaaccctgtctctgctaaaagtaccaaaaaattagcagggtgtggtggcgggcacttgtagtcccagctactcaggaggctaaggcaggagaatcacttgaacgcgggaggcagaggttgcaatgagccgagatcacgccattgcactccagcctgggcaacagaggaggactctgtctcaaaaaaaaaaaaaaaaaaagaaagaaagaaaaaagaagaaaagaaaaagagaaaatactgaacttggctaggcatggtggctcacacctgtaatcccagcactttgggaggccaagacgggcagatgacttgaggtcaggagttcgagacaagcgtgactaacatggtctctaccaaaaatacaaaaattagccaggcgtggtggtgcacctctgtaattccagctagggagtctggggcatgagaatcgcttgaacccaggagggagaggttgcatgagctcagatcatgctactgtacttcagcctgggcaacagagcaagactctgtctgaaaaaaaaaaaaaagaaaaaatactgaactgggcttggagggtttatcttaatatccacattcctgggcctggaccacttgcttccagcattttcttctgcaacacaggcccttgctttgcttcaccttgaacctggggctgtagccttcatgtgcatccttgtgtcttcccacagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtg

SEQ ID NO: 37539 - DNA, 207 bp, Homo sapiens
atgcagagcagagacacagtgaatgttaagtttactcccagatccttctggggctcgcgtcctaaacatactgggggcagatctgagatgagggcccacgttccccaggccccctgggcaaggcaagcgccgcctgttctgcccctctggaccgtggtgaatgaccatccccatgagaaacctgtttcaagaccccagaatacatag

SEQ ID NO: 37540 - DNA, 18085 bp, Homo sapiens
tggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctggtatgtggctgggaccctaggacagcaacgaggcaagggccagacgcggatcaagccgatggcctctggagaatgttgaagctgcggtggggctgttctgccgtgatgctcagagagaagtgattctttgaagtgtaactagttcagttaaaggaggccctttgtggatcagatgtcattttaaactccatcaccgtccctccatagccttctgagttgtgtgttcttttatttacagagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcagggtaaggaaaatctcaatcatttcccaatacaccaggctttctctcctacagagatgaaaaggcatgaataggctttacttaatgggacttttctgttgtatggtttttgtccagtttaaaaatttaccatattgagtttgaacttcccaaatgccttaaaaatctgcattcgatacaaatattaattgaatttgtaaattagttctgagatcacaccaaaatactggctcttcttctgtgtatcttttataatgttctatgtcaaattgagaaaaggtcgagtaaagagattgccataaacagaagcaggtaaataatgaatataagcacttgctgctttacaagaagtatatacagtcagcgtcgggaatatgttctgggatatgttttgtcagatgacttagtccttgtgcgaatattatagagtgtacttacacaaacctagatggtatgtgtatatttgtttatatatttttttcatatggaaaaccaaatgtcccagcaccattactgaatatcagtcatttcatctacttgatctgcattgccggtatccagtgccatatatcaggtttctgtatattctccattatactgttatgagaccaccatggtatgagcggttggtcactgatcaaaatgtcattatgcagtgcatgactgtgttttaatggtgctcttttgattaaaaaatgtattattttgataagaaacatgcatatatatgtgtgtgtgtgtgtgtgtgtgtgtatatatatctttttattttgctctttcacccaggctggagtgagtggcatgatcttggctcactgttaacaggtgcctgccaccaaacctggctaatttttgtatttttagtagagactgggttttagcatgttggccaggctagtctcgaactcctgacctcaggtgatcacatctcggcctcccaaagtgctgggattacaggcgtgagctgccccaccgagcctatgtatatattttaaattctgtgctatcaatccgggaattagacatttaaatttactttgggctttcttttctgggtgccaatttcataccagaatcgataaccgaaattaattatattttcctttttaaggattcttttaccatcatccggactggtatagtctcatctctgttaatggaatataataatggaacaaagaaaggcactattctaaatagttgataaagtgtaaaatatcatagaacatgatagagtaactcctctttgtccctgttgccattctctcattcaggcttttatggtttcctgccaaggagtggtttcgttgtaggtttcccttgcttcattgtttgacgtctctcctttctccactcatccatctgccagtgccagattaagtttcccagatcacaatgcttttatgacatcctggcatcttcaaaaaacaaaaaaaaattttttttttttttttttttttgagatagagtcttgctccgttgcccaggctggagtgcagtgtcgcaatctcggctcactgcaagctccgcctcctggattcatgccattctcctgcctcagcctcctgagtagctgggactacaggcacccaccaccacgcccggctaattttttgtattttttagtagagacagggtttcaccgtgttagccaggatggtcttgatctcctgacctcatgatctacccgcctctgcctcccaaagtgctgggattacaggcgtgagcatcttcaacatttctaaaggaaaaagttttggacttaacttgcttttcaagtaggagactcagtcacaagtttgtctctcacggatcataaagtttgtttatgtccatactttttggtggctttggcctttgaaagaggtccgctcctccctactcctttctctttatacttcagttccagtatctttccgggtctagctcaagttctttctctgttatggtatgtccatttttcagtcatatcttcagtgcctaaacttttcatgtgctttattgtcctatttattgcaggataatcactttggattccactaacatttgttgatgctgccatataccagacacacagtggtattacaccatgctctacatcatttagtcttcaggatattcccatcttaaagatgtgaggaaacttggccacagtcatcagtctaataagggaaattttctattatactagtagggaacactcaggatcttctactctgacctcctcattttactgatgagaaaactcaagacctaaagtatctatgggacttgtctaaggtcacatataggattggaactagggtctagttttaaatgggaaagctctggggactctcccattgcacaagcccatatggttttacatttgttgaatacgtggtctcttcaactagactgtgaatgtgcatgggacagtggaaataacagttttgaaatcagacctgtgtttaaatcttaccttttttgctttttagtactttagtttcctcacatacgaaggtagtcatatcacttaacattcaaagttgttgtgaaggttagagttatggtgtgtaaagcatgttatttatagtacgtgttatttacagtggtaggctttttatgaataacagttatttctgcatttctcaaataaactttgaggacaggttcagtgcttcattcattctttatttccccaatcagtgcatgcaggtagttaggcctggagctgttggtttaagaaacatcagcatataaatgataactaagaagattaagtcaggaatcccagggaagactgccttgagagagaagagaagaggacattgggcattgaagggatggacagaaggtagaggttcttcagaatgggagagattgggttgtgccagaggagtcttgctgttaaccccaaaatctgatcatatagtgcggttagttatttgacactctttgggtggaacagccaagctttggagctgggaacgttttgttttgcaaataaagtacagcacttatctgaccagaacctgtgtcatacagaatatattagggaaaggtggtggtgaaggaaattctccaataatgggaaaggacatttccagtattttgttaggacattttctgtttgattctcaacggtattttgtacccttttttgttttttaacagacttgtaaagaaaccaaggatgttagtgctctgacaaaagcagctgattttgtgaaagcttttattctcggctttcaggtggaggtgagtaattccatgatatctaaaatggggactttaaaaatattcaatgtgaacatttcaatggattaggcattaaaaaaaaaaaaggccaggcacagtggctcacacctgtaatctcagcactctgggaggctgaggcaggtggatcacttgaggccaggagttcaaaataatcctggccaacatggcgatactctccatctctactaaaaatacaaaaaaattagctgggtgtggtagtgcatgcctgcagtcccagctacttgggaggctgaggtgggagaatcacttgaaccagggaagcagagattgcagtgagccaagatcacgccactgcactccagcctgggcgacagcgtaagactctgtctccaagggaaaaaaaaaagctttctagctctagagtttgtggattttagttccatagtgctttgcactttactctttttcaggtgtgcaaatggaaggggcttcacggtgtttgtttttatattataggatgcacttgccctcatcaggttggatgacctcttcctagagtcttttgaaattacagatggtgagtgtgtgttggtctgcgctcttgtgtcgctgactttgtattgtgatgtgactctcagttttctaatagcatcaattgagctgtatttttagcaacttatatatatatatatacactttgtgtcctttagagaaatttagtttatgattaaactttatgtggaatgggtggtacactagaatggcttgcctcctgagatcttgcttttcttgtttagttaaacccctaaagggagaccatctatccagggcaataggaagaatcgctggcaaaggaggaaaaaccaaattcaccatagagaatgtgacacggacaaggatagttttggctgatgtgtaagtatctgatcttgagaaaattattgtcataatttatatttgatcttttgttttaagaaagtcataacagttgtattttatgcataatgttgctgctaaatctttgtcagtgcagatgctcctcataaatccatcataaattgaaaatatcataagtctaaaatgcatttaatatgcctgacttatggaacattatagcttagcatagcctatcataaacatggtcagaacacacattagcctgcagttgggcaaagtcatccgacacaaattctactttatgacagagtgttgaatattgaatactgtactaaaaatgaaaaacagaatggttgtatgtgtatttgaagtagagcattctgaatgtgtatcacctttgcacccttgtaaagttgaaaaatcccagttcgaaccgtgttaagttgggaatcatctgtatacttttgggtgaatagatggtcaccaactttgaaagaggcttaagttgagaaaatttaagaaattatatattcttttctcatttaacaatgaggaaatgctattaaaagaaattattacaggtgaagatttaaataatatctcgggttgggcacagtggctcacgcctgcaatcccagcactttgggaggctgaggcgggcggatcacctaaggtcaggagttcgagaccagtctggccaacatggtgaaaccctctctctactaaaaatacaaaaattagccgggcatgtggcatacgcctttagtcccacctactcgggaggctgaggcaggagaatcacttgaacctaggaggaggaggttgcagtgagccgagatcatgccactgcactccagcctgggcgacagagtgagactctgtctcaaataaataaatacatacatacatacatacatacatacatacatacatacatacttactcaagggaatctattaaatcactaggggagaacaagcaatcactatttcagatgcccttgtgagtctttagaagtatatatctactttatgtatatacatatatatgttaaggccttttataaaaggaggggaatatcgtacattaggcaaaactagagagcagttatatgtgaacataaacaagatgagaggggcttaaaataaaggtgccagaagtgaagctgggattacccctgtctgaggttgaagctgcccaggctggggatcttactggcagatggctcagagattatataatgccatgaagttgggaaactgaacagttgactgagaggaggagggttctgcctatgactaaattctgaaataatttcatttaatatctcaattttgctccatactgaaggactcttcattatatagaacctaaattttgtacattctttacactttaaggataactatactactgtgttggtggccctctttacctgaagccaggcatataattatattgtttgatcttttatggattgagcctagagtcagaaatatggagccttgggagaagctattttgaactggaaatgtgcaaatgcacaccacatttaaaaatatggccaagcatggtggctcacatctgtaatcccagcactttggaaggctgaggcaggtggatggcgtgatctcaggagtctgagactagcctgggcaacatagtgaaaccccttctctacaaaaaaatacaaaaattagccgggtgtggcggcccacacctgtagtcccagctacttgggaggccgaagtgggaggatcacctgagcccagaaggttgaagctgcagggaaccacgatcgtgccactgtactcaaccctgggcgacagagtgagactctaacaaaataaaaataaaaataccacatatagtctgggcgcagtggatcatgcccataatcccagcactttgggaggccaaggtgggaggaaggaatgcttgagccctgaagttcaagaccagcctgggcaacatagggatctccatctctacaaaaaatataaaaattaggtgtgattgtgcacacctgtagccctagctgctcaggaggctcaggtgggaggattgcttgaaccaaggatgtcaagaccacagtgaaccatgatggcaccactgcactctagcctgggtgacagagtgaaaccttgtatccaaaaaataaaaaattaattaatttaaaatccatatacagatgctcctcaccgtatggtggggttacgtccagataaacctgttgtaaattaatgatctcataagtcagaagttcatttgatacttcatttgatatcataggatacttctctttgaaaactgaagagcattccgagtgtgtaccactttggcgcaattataaagtcaaaaaaaaatcttcggttaaatcatcaagtcatggactggctgagtagccctgaaagctttcatgaatttagaaatccatggcccggcacggtggctcacacctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaacaacaaaaaaaaaaaaactagctgggtgtggtggcacatgcctgttatcccagttacttgggagactgaggcaggagaattgcttgaacctgggaggcggagactgcagtgagtcaagattgcaccactgcattccagcctgggcgacagagtgagactccatctcaaaaaaaaaaaaaaaaaaaacggctgggcatggtgcctcacacctgtaatttcagcactttgggaggctaaggcgggtggatcacctgaggttaggaattcgaaaccagcctgggcgacagtgagactctgtctcaaaaaaaaaaagaatttagaaatctaaaactaactgatttgccaatgaaattatatagtctgtcattaagtttattactggtaaatttataagtatatttgtaagtgttaacctaaaatttactagttaaaccaacgttttagaagtttattgtggcataatttacatacaataaaattctattgttttaagtatcccgttcaatgagtttttggcaaatgtatattgtagtcccatgacactcatacagttctcttaccctgaaagttccctcgtgcatctttatggtcagttgcctgcccccacccttttctgggacaaccattgctcttgtttctgtcactcttattttgcattttctagaaattcatataaatggaaatacacagtatgtaggctttggtgtatgacttctcttaattagcatgttattttggatttctccattttgttgggtgtatcagtagttcctttttattggcaagtactatttcattgcacaggtatactgttgacccttgaatattgcagggattagggatgctgaacccctaacatggttgaaaatccatgtatgtatgacttgactctcccaaaacttaactactcctgcttttggctggaagctataccaataacaaacagttgataaacacatattttgtatgttatatgtattatatactgtactctttcataaagtaagctagagaaaaaatgttattaagaaaattataaggaagagaaaatctatctactcttcattaagtggaagtgggttatcataaaggtcttcatggtgaataagctaaggaagacgaggaagaggggttaatcttgctgtctcatgggtggcagaggaggaagatgtggaaggcgaggcaggagaggcaagcatactctggaactttacagaaatacattgtaatttctgacttttttgccctttcacttctctaaaaatgtttctgtagggtaccaatcctcttccacagtttttagtttcagtgcccacgtcataaaagggtctatgtcataaaagacgtcaaaagcatcttgaataatcagaaaccttctgccaaattgtctaatgtcaccttgttttctgacactgctgcttctacatcatcttcctcatcacccggcactgcttcagaagcactcacctccatcaagtcgtcttctgttaattcctctggcatagtgtctgttagctcttgatttctccgtgatccatatcttgaaacccttcacccctcacttttggccatatccacagtctctttcatgatttcttgtttggctctgtcgtaaatcctgtactgtcatgcaaaacctctggacatggttttctccagcaggaatttatagctgcaggcatgaggctttcacagctttttccataataatgacagtgtcttcaatggcatggtccttccagacttttatgatgttctttccatcgagttctcttccatagcattgacactattttccatagagtagtgtgtgtaatgaaccttaaaggtctttatgactacctgttctggaggctgaattagagagtgggtgcaaggagaccactttgttgcctttcggtattgaactcatggggttcttgggtggctgggacattgctcaacatcaaaagagctttaaaaggcattccttactggcaagatacttcctgacttcagggaaaaagcatcaatggaatcaatccagaaaaagagctctccttgtgcaagccttcttgtacatccagaagacaggccactggtgtttaccttttcccttcaaggatcggggttagcagctttatagataacggcagtcctgatcataaacctgactgcatttgcacaaaacagtaaagatagcctatcctttcctgcattaaatcctggtgtttgcttctcttctttactaataattgccctttgtgacatttttttccagaacaggacgtttttcatctgcacaaaaaacctgttcaggcagatattatttctcctcagtgattttcttaatggcatctgggaacttgtctgctgccctttggtgagcagaagctgcttctcctgttaccctgacatttttaaagccacctctttctaacattatcgaagcatcctttgctggcgttaagttctccagctttagatccttcattttccttttgctgtaagttgtcatataatgacttaatttttttctccatcatattagactctatagatgtgtctttcttagaacaatcctgcacccacataaaagctgcatttccaatttgagattgtcaagaaaagaatcacaagatctataaatttggagaggaaactttatttcttagaaagggttgcagtctgcagggtggccattctgacaggctggaaagtatagccttcagcagagaccaaaagcaggcactctgaaggaggaaaggatgagacaggaatttatgctgaatgcgttggccaagtatacttatttaacaggttataggaggagctctgaatataagaggggtcctaatgcttgtataccgagtaaatgtacaacccctggtcgctttggggtggagacttaacatttaaaatacctgacaattagatcctgtatgttacaagatgaaatagggacagggacatgacaactgaatgcactgcctctggaagctggtagtaccagtccatggtcagtgatctcttatcaggagatgttactgggatcagtctcttgtccaatcaaagctgtagttactgtttgtggaacagagtgtgggaagagggaagctggggtcaatctgtatctagctgttggtgagctgtaattgttttaatattgtttatcacaaggccagtgcttgttaagctgctagagaaaaaaaaatatcctgtggcaattagaatgtcatttactctttaagtgtagggtgtatgacttaacccttgcccaggtggtcttaggtcttgtttacaatttgatatcttattgccacagtctgttctgtcttgcctgggcgcctaggggctttatttttattttataagataaaggggtatttggcaaaactgcaggtgtattcatatctgctgttatagctgcagtgacagcttcatgaatttccttttcttttttttacaatggtcctatggtatagtcatttatcttgaagtggtgggcaactgcaactgcaggcctcagtcaacagtacctatcaagcaattcagcttttttctttttttttttttttttttttttttgagatggagtctccctctatcgccaaggctgaagtgcagtggtgcaatctcggctcactgcaacctccacctcccgggttcaatggattctcctgcctcagcctcctgagtagctgcaactataggcatttgccaccatgcccagctaatttttttgtatttttagtagagatggggtttcaccgtgttaggcaggatggtctcaatctcgtgacctcgcagtccacccgcctcgggctcccaaagtgctgggattacaggtgtgagccactgcgcctggccagttcagctttttcttgtactgtcatgacttttctgtgctgctttggagcactcccaacatcactagtggcactttatgtgggacccacgttgggtgggtcctatggtcccaaagcttacaatattgcactaagattaaaaataggcaagaactgcgagaaatcactttctactgtgatagacagtttattggagagtcaaaactgcttatgggagataatcagcatcacatgtgatcagcatcacatggcattctaagtggatacttgcaacacctgagctcaccacaagagcaataggtggtggctgtgaagttgtcgtacagtatgcactacagttaattttatggagttatgatttaatactgcatctttgcatttgtttccatttctcttgactacaaatggcatcatatatggcttgtgtttgtgtgcgtaagttttaattttaactttttataatagatttgtgtatattttacggtagtaaataagatagactagtacctacatacagtttatgcattcatgacgtagctttttcttaatttttttgacatttctacgatacttagctcctctctgggttttttcacatctccaaaatatcttccagtatatgtgttgaaaaaaatttgtgtgtaactggacctgtgcagttcaaacctattattcaaaagtcagctgtattacatcttgtttatccagtcacagtagatggacttttgggttgttttcagtttgtggctatgagaataatgttgctactgaattacttatatcttttgtgttttcttacaaactgaattacagactacttgaaattaagagatgtactatctcttgcttttgctgtagacaggctagttggaaatccacgtttaacagtttatattaattataataaagctgttagatgggctgttgtgtacctataaaagttatttttgatgagttgccaataacctggcaaaatacagtaagtataatgtgagccagatagaaaactaaaaacaattggttccaggtatgtttaatacagcagatgggaaatgatgttgcctctgtgtcttgaagcctccattcctttccaactattgccccattactttggttctttgtgcagcaaaactactcccatctgttcttgttgtctttatttcctcatctgtcatgctctgttttaaataattttaatcaaagttaaacatacacatagttttaaaaagccaaatattggccgggcgtgatggctcacacctgtaatcccagcactttgggaggccgaggcgggcggatcacaatgtcaggagatcgagaccatcctggctaacacggtgaaaccccgtctctactaaaaatacaaaaaaattagtcgggcgtggtggtgggcacctgtagtcccagttacttgggaggctgaggcaggagaatggcgagaatccgagaggcggagcttgcagtgagccgagattgcgccactgcactccagcctgggggacagagcaagactccgtctcaaaaaaaaaaaaaaaaaaaaaagccaaaaatttctactgcctacctccatttcacccttttcaggggaaccaatttcaactcttttagcttatcttaaaaaattatttgtctctgtatttccagatattttgttcatatacagcctcttatttttcagattcactattgactttctaccatcaaagatgaagatttagctgtctttcacccccttacttccactgcacacactcagcctttctgtcactccgatttattcttctctgtcctcctgatggtccccttgtggtttttgttagattcgtgttcagtattacctgaaaacagaaatcagtgctcagtgtacttatagctgagccaggtgaaatactgtgactgccttatctttcttttgcagcattgttttcacttgaggaagtaactcttatgtgtctatgtcctttcttcattttcgtcgtactaattcagtaagaagctatacgttgtctgtatctcctcttgatgtattcgaatgcatctaatatttgagaaatctctcctggagatgttctgttccaaaaacgcccccatgctttctgcgtgcattctggctgcacagccatcatcctgggttccctgtcccctgcctcttggagtctctttcccagagttctgcttcttgatattcctgctgctgatttaggcatcagttgacttcggtctgcacagtcagttccatctcctccatctgctttccacctttttggactttgctactgttattactctcttcttccttttgggcttacatctttcctgtcattttagtggagtttgaggaaggagcatttgtaaatgtttgttttgttcatctgcaggtgtctggaggaagagcattacagaggaaggggaaagcacaaagatcttgagttgagggcacatctggcagtgagcgaggaggcttgaccaaggatgaaagggagagagcggagagtgacagatgagtcaaaaataatagggcctcactgaggtcatcataaggactttggcttttactcggagtgaataggaagtcattggatgattgtgagcagaggaagggaggtgggatgtgagggggcgaagggcagtgaaggtgagtaggatccatagatgggaggtcctggggtaggggtgaaggattatttgtgttgatatgagtggaatgacagaaagtggtgaagggagagttggatgtttgaaatcgaaattatgggggggttgcagtttttggtaatgaccaagtccagggtgtgaccatggatggaagaggctggagtagggtggaaaacaagaccccatgttggcataaaggatatcaaggacctgagaggctggcatgttgggattatcatcttcatgggtattgacatgatcgagcatggtgatggggaatagcaagagaaagcaagccaagagctaacatcttcacaggtgatctgtaggggcagctgaggaccgcagccaggcagggtggtgggtgatgtggcctcagagcagatccaaagccaaagggtttttagggaggcaagagggagagcatgtggtctggatgtggcatgaagacacctgctcctcccccaggcccagaggtacctggtttgtggaggaagaactggccaccatttgagatctggccttagttgaagccagaaggtgaagggaatattaacaggggttgaagatatagaagctttagctgatttgtacagggcacagtgaaaacagtttggaagatggactcaaaaaggcaaaattgtatcttgtcagttttgtcattcagtaaagaatgcccattaaaagggtctaaatgatcctcagagccctgaagaaatttagataatctttaggaaactttgcagttgaaaaccaattatgttgaaattgagtacagtattgcatttatgggtattcagtaaccagctctgccagtgtgtcgtcttgggcaggctttttgatttcttataaacttctctcctcatccgtaaaacaggaaggtcatgtgaggattaatgagggcatgcatagaaagccctggcacataaagcactcataggatgggagccatcattaaccaagaatcttcacaaatttttctttttcaaacaattctttgtcttttctaataattttttattgggatacaattcatataccataaaattcacccttttaaaaagtggtttttagtatattcatggagttgtgcagccataaccactgccctcattaaagaatctgactcaaatatcatgattttccagcatttttggagtacaggacttaggtaaggaaatgcttttttgtctacaatgtcttttttttttttttttttttttttaagagagagggttttggtctgtcactcaggttggcatgttgcactctacaggcacgtgctactacacccagctaactgttgaatttttttgtagagatggcgtctcattatgctgtccaggcttgtctcagactcctggccacaaatgatctacctgccttggccttccaaagtgctgggattacaggtgtgagtcattgcatcccagccactaatttgtctcattttatttctttcaggaaagttcacatccttggctccttccaaaatatcaagatggcaagaactgccatttgcaacctaatcttgggtaatagcagtttctttctttggtgttttctctgggagggataggaagttaattgaggaagtcaaaaccacatttgcaaagcaatttagggtaatattaaagatcgcaagtagaaacccttgggagttggcaaaggtgggcctagagaaggaagtagaattttttttttttttttttttttctgagccagagtctcgctgtgtcgcctaggttggagtgcagtggtgcgatctcggctcactgcaacctctgcctcccaagttcaagcgattctcctgcctcagactcatgagtagctgagactaaagacgcctgccaccttgcctggctaatttttgcatttttagtagagacggggtttcaccatatcggccaggctggtctcgaactcctgaccttgtgatccgtccacctcagcctcccaaagtgctgggattacaggcgtgagccaccacgcccagccagaagtagaaatacttttgcttagattccatttgtctgcaagagaagagaaggtgtttattgggtaatattgcttaaatctttgctgccttcttgataaggtgcagagaaaaaccattccagaatagcagggaacatcacattttaggtttaacaaaggaagagctgctgaacagcttcaggcaatttaattgatccacttaacccattttcttgatcctgcagcaaagtcagtactttctgataagagttgcaggatcttagcggcttgctcagaaaattgggattttctggttctcaggcctcagtgattggcttctttttgaaatattttaacaactcagtgcctttcgctcttagaagtttaaaatattttttggagaatatttgggtattatttctgttaaggttttttttttttttttttttttgtaatttccaattaaaatgtctctgttctttttagggttctagaccctttttcacgtacagtctgccctctgtctgcaaggtccacatctgcggatcgaaccaatggcagatcaaatactcagaaaaaaaatatataaaaataatggcaaattaaaaataatacaaattttaaaacacaatacagtactatttacatagcatttgcattgtattaggtattataagtaatctagagatgatttaaagtatatgggaggatgtgggtagttaatgtgcatattttttatgtaagagacttgagcatccaaggattgtggtgtctgtgggagtcctgaaaccagtcttccttagacactgagggacaactgtaggcgctataaatgtgagtttatttgtgtatatacttttttttcccctttgcaggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccagctgaacaatttcagtcatttgaagcctccgtcccttcttccattctcagccagaagcataaacagaaaagaaagatttaagaggattcacactcaacaggttttaggataatttaaatatcaaaaattgattgttatacttaacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttttgcagtttcttgcagtttcaaaaattaaagacctacatcacagggttaatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgt

SEQ ID NO: 37541 - DNA, 17820 bp, Homo sapiens; identical to SEQ ID NO: 35685

SEQ ID NO: 37542 - DNA, 61748 bp, Homo sapiens
attgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaaggtgagagacagctgaacttgaacatgtgggctgtcactgagagcggtcagcagaagaaaatttgagccatgggtaaggcctggtagaaagggaggaggttggggaggcgtgaataggcctttggaaagaggtgctgttaacccaaaacagagaggcagcagctttgcaattagattttctttttgaaatagcaggctctgtccctggtagcaatagggataaataaaaagtaatatgtattcattgggaaaataattggaaaaagaattaggcaaaataagcatgtggttttgtatcttgttttttaaaacagcttgttgtaatacattagatattctttgaaaaaaatagaatttgaagttcagaaaatcaaatcagttttagggattgagaatctcactacatattttgtctttcaaaattgtttgtttatttatttatttagaaatggggtcttgctatgttgtccgggctggagtgtagtggtacaatcatacctcactgcagcctcaaactcgtgggctcaagggatcctcctgtctcagtctcctgagtagctgggactatagtcaggcacacctcaccttgttcccagaccaaactgagggtcgggctgcttattcttgcggcccagtaatgagatgcagatgaactgggaaagaagggagtttattgctgtaactgggtacagggaggtctggaaaatatcaccagaacaattcaaaattacaaagttttccagagcttatataccttctaagctatatgtctatgtgtacgtgtgcattcatctaaagacataagtaagtgattaacttcttctaatctataactaagatctgagtcctgaaggccttcctttggagccttcgtaaattcatttaatctaaatgggtgaaggtgctggggtgattacccttatcttgtgtcctgctaaatcacagggttttggggagttcctttagtccccagtaaagcttgtttgtgaaggtctggggagttccttaagatccacaataaaacttgtttaatcctaaatgggtcctgttaagaattccttcattattttgtcatgctttaaggcccaggaaaggcctaggcaaaactcttggtgggcttttgttacattcaagcctttgtatagggcactgatgctatcagcttttaatatttaacctaaccactcagtcagtgctgaaacagttgttatggaggcctacctgttcagccattatggagacctggcctgccacaaccttgcctggctaacttttaaatttttgtagaaacaaggtcttgctgtttgcctaggctggtcttgaactcctagggtcaagtgatcctcccatcttgttctcccaaagtgttgagattacaggcatgaactactatgcttggccatctttcaaagtttatatgtgtattcatccatttccttattgctgataaaggcatacccaagaatgggtaatttataaagaaaaagaggtttaatggactcacagttccacatggctggagaggcctcacaattatggcagaaggcaaaaggcacatcttacatggtggcaggcaagagagagaacgaaagccaagtgaaaggggtttccccttgtaaaaccattagatctcatgagacttattcactagcatgtgaaaactacggggggaaccacctcaacaattcaattatctcccactgggtcccttccacaacacatgggaattatggtagctataattcaagatgagatttgggtggggacagagtcaaaccatatcattccactcctggccccttccaaatctcatgtcttcacatttcaaaaccaatcatgccttcccaacagtttcccaaagtcttcactcatttcagcattaactcaaaagtccacagtccaaagtcttacccgagataaggcaagtctcttccacttatgagcctaaaaaacaaaaagcaagttagttacttcctagatacaatggaggtacaggcattggataaatatacccattccaaatgggagaaatgggtcaaaacgaaggggccaaaggttccatgaaagtccaaaatccagcagggcagccaaatcttaaagctcctttgactccatgtctcacatccaggtcatgctgatgcaagaggtgggttcccatggtcttgggcagctctgcccctgtggctttgcagggtacaccctccctcctggctgctatcatgggctggcattgagtgtctgtgacttttccaggcacatggtgcaagctgtcagtggacctaccattctgggggctggaggacggtggccctcctctcacagccgcactaggcagtaacctagtggggactttgtgtggaggcttcaaccccacatttcccttcttcactgccctagcagaggttctctgtgagggtcccagccctgcaataaaattctgcctggacctccagttatttccatacctcctctgaaatctaggtggaggttcccaatcctcaattcttgacttctgtgcacccacaggctcaacaccacatggaagctgccaagtcttagagtttgcaccctctgaagccgcagcctgaggtgtaccttggcaccttttagccatggctagagcagctgggacgtagggtgccaagtccctaagatgcacacagcagggggcccctgggcccaggccacgcaaacattttctccttctaggcctataggcctgtgatgggagggggctgccacaaaggtctttgacataccctggagacattttctctatcatcttggcaatctggctcttcattacttatgcaaatttctgcagccagcttgaatttctcctcagaaaatgcgtttttcttttgtattgcgtcaggctgcaaattttccaaacttttatgttctgtttcccttttaaaactgaatgcttttaacagcacccaagtcacactttgaatgctttgctacttagaaatttcttctgccagatatcctaaaccatctcactcaagttcaaagttccacaaatctctagggcaggggcaaaatgctgccagtctctttgctaaaacataacaagagtcacctttactccagttcccaagtgcctcatctccatctaagaccacctcagcctggatttcattgtccatatcattgtcagaattttggccaaagccatttaacaagtctctaggaagttccaaactttttcacatttttcctgtcttcttctgagccctccaaactgttctaacctctgcctgttacccagttccaaagttgcttccacattttcaggtaccctgacagcagtgccccactctaccagtaccaatttactgtattagtctgttttcttgctgctgataaaggcatacccaagactgagtaatttataaagaaaaagaggtttaatggactcacagttccacatggctggggaggcctcacaatcatggcagaaggcaaaaggcacgtcttacatggtggcagacaagagagaggatgaaagccaagcaaaaggggtttccccttgtaaaaccatcagtttttattcactaccaagagagaagtatgggagaaacttattcactaccacgagaaaagtatgggggaaactaccctcatgattcaattttcccccaccaggtccctcccacaacacatgggaattatgggagctacagttcaagatgatatttgggtagggacacagccaaaacatatcaatataatcaaccagaacctataacttttcctcattgaagacatcagaaattgccacctgtattgtactaattgaatgaaatttctgtgtaacaaagccattccagcttctgttggattatccacatgaatgatgcccagctgattataaaaaattctgtactccatgctgagttcctgtaactctagaaaaaggaaaaaaaaaactgtactccaaatagctacagaaactgggattttaaaaatccctttcttcaaagaaagaacctcagaacaattggtggtgtgcttaacccaaagcatttggagtaggacagacttgggtgggatctgtctttgccacttcctggttgtattgttgtgggaaagttatttgaacctgctaactgtcaatgtgttcagttgcaaatgggaataatcttaggctacttttagaattgttgcaaaagtaagtgaaataatgcatagagggcacttgtcacagtggctggtacatagaaatgaaccatttattgctaaattgtagtattattgcaaacagggagcctgcattgatttatgattccactctaagaatatagcacaatcagtgagatattataaggactcaatcagtgcaaactgaatgaatgaataaattgcatgggttgctgtagcttagggcaggatgggcagaggtgtttttttttttaatcaaatatcctcatattgttccctcttccaagatcctagttacctcaaaagaacattgcttaaatttacagacaacccatacccatgcacaaaatgcttgtgcttaaacaaacactcaattaatgaatacgtaagagttaagtgatagaaagtgggtggggatgcctgatactctccatctttttcccttgaggtcaagcacttgttttacttgctcattcactgcaaggaaaaggcagctcctccagttctcattcatccacagatttcagcattacagtcacgttaagatcagctgtcaaaggctcttttcaacacactagattctgagcaccacagcttcgttttagaagcagcatagaataatatactgggcttctttcctttgctgtcaattccagaaaaagctactcaatacctataaaattctacagattaagggtatgatttccagccaaaaaaaaaaaacccacaaaactttaataaaattcaattgcatcaaaacaaacagaagactgtggggtttggggcagtagacagtgtttttattccctatcgcccagcagaactcagcaaagcaggctgcacgctggctctgtgaggacttggaggtggctgcctaagggcaggatttaacctgcactgtcctgaattaacactgagcacttaatactgagggcagagaagaccaggggcattcagaccccgggcagggccagatccagcaagggaggggctgggaatgattaaattcagctggtattggaggagagtgtgagctagcaggcaaacagacaggagagaacaccatgatctctcaggtcaggggcctcttttagggtacttcattctgactgagaatctttcaggatactacctcttctacaaagcctatcctgaacccttattagaactctgatgacatttatttgtccctcttttagaagacttacaggacttctaatgattcatttagcttacatacatgcttcatttccctccataaacccccaaaatctcaggtgcctcatttccctccatgaacccccaaaatctcagacaggtctctcagttaattcagaaagtttattttgcgaaggttgaggatgtgcacctgtaacactgcctcaagcggtcctgacgacatgtgcccaaggtggtcagagcacagcttggttttatacattttagagagacatgagaagcaatcaacatatgtaaaatgaacattggtttggcccagaaaggtaggacaactggaggcaaaagcaggacagggagggggcttccaggtcacgggtagatgagagacaaacaattgcactcttttgagtttctgattagcctttccaaaggaggcaattagatatgcatttttctcagtgagcagagggatgactttgaacagaacgggaggcaggttggccctaagcagttcccagcttgactcttcccttagcttagtgattttgggaccccaagatttatcttcctttcacgtttccctccttttctttttaaaatcttttggagaaagcattttaggagaaaatgagtccctcgtcccaggtttcatctggtgtctcatggctaggatggtttattcctagataggtaggtcccaagttattaggaaagctcatatttagaaggttgtgaagtctcatgtcctttgaagagaaaacagggggaagaaggtagaaaaacaacaacaaacaaaagaacaatcctggaaaatcgatataggccacattactctgaagtttatacatcagtaggtaggtatgaaagtggctaatgtatgtaaataaggttgctattattttcttctgaaggttgtctagcttcagtttgtggggctttatgaaagcacagctcagttttcagtgactccaaattaggaaaaatgggaaaagaagaagaaaaaaattgaaaacaaagtaacaaaaattactttgaagacttggagccaagaaaaattagaattcagttcaaactttaaaaaataataaaaatcaagaaacgttaggcaagactagaatctaacaactgctgtactatagttttgaatcataatgtttctctcttcagtttcccgtttgtactaaagaaaaatcatggtaggactggtttgctttactatacttggcctaattatttgtatacaatgcagccagagtaattatttttttacataggcttttaaattggctttgatggaactttgttccatagaaggaatctcagataagacatttttttaaagctgagcccagctatggatttgtgccatcaggtacctatgagttgagtgatcctttcctcttgaggttccaagataaacttggggctcctgggcctgtcagaaagtgacattctttacttatgacacatcaggaaccctttacaatggctgtgtagacaaaggtatcacagcagtttatccaatgggcttttattgcctccataagtcaattttgaatccttaaaggaaagcacaccattccagtcaaaactttagtaaaataaccagtttctccaattgtgtcctgttacaaatgaaaacagattcttattgcacttatgcaaataactgtattgtcataagaatactcacacatagttcccaaattttggagaaatcaggttgacagaaacaaatatggtctaaattttgttcatagaagtatacttcactcaattgttaaaagctgtaaatagcttaaaagacgttttcttgtatctgaaaaacaaaacaaaggatcagcaacattttaagcaaaaagtttaaaagattactttagtcttttattagatcagctcacgcagttagcttttgttctgacattcatgaacatttcagttctccatgagagtcctgaaagtttttttctctattctaatgttccaatctccaaagttatcagaaacttgcatctaggaacacctgttagagttctatagttgattataaaaccactttctaaggaggaccaaaacaagacaattgtttgtggatgacaaaaggttttaaggcagccacagtcaaagacacaactgacaaagaaacttatctctgtggcagcaacaatttaacataacaattataattattactgataatgtacattaagtcatatcaaaattataggagtttcccatgattttggaacacataccaataacatatttatataaatacagcccaaagaaagccaaacaccatttcatatttgacaaagtttcctgtatgatttttataccaaataagccaaattatgtcattttggacttcaggaaacctaatatcttaaaggattaattcaagcagaaaaagacataatttataatttgattttggaaaggttatcaaatatcaaaggtttagaacacttgatatcacaggttattgtaaaataagtcattcatttgaccaaagtgataactcaaggatttaaaaaaaaggcaaaaaccttctctttgagaaaagagagctaattttccaaacaataagccctagtaacaacagcaggaagctggctgggtgcggcggctcatggctgtaatcccagcactttgggaggccaaggcaggtgggtcacccgaggttgggagtttgagaccagcctgaccaacatggagaaaccctgtgtatactaaaaatacaaaattagccaggcgtggtggcacatgcctgtaatctcagctactagggaggctgaggcaggagaatcgcttgaaccttggaggtggaggttgcagtgagcggagattgcaccattgcaccctagcctgggcaacaagagcgaaactctatctcaaaaacaaaacaaaacaaaaaacaaaacacagcaggaagccaattaaatttgttctctaaaattttataaacaatctataaaattttaatcttgaccataagctataacttccataagcctttcataacctttataacctttacttaggagttggttaatatttcataaaaaccttgttaatttgacatgggctcatatgctggtcttgcatcagtgtgcctttgacattaatgattaatttatagagaaactgaacttattttatctctcaacattggctcttacaatctcacatgcccctttcctgagaaagttgaatgacttgaatttttggccctgtgtttcaggaatgcagtttattttgattggcattttctaccgagactaaagatgggattttaattgctgtcagtgtttaaactttagcaggacttggtatcttttttacacccaggagtcaaagccctgtaactaaatgtcacaagtactttaaaacctcatacagagagacatatgggtgtaataaccttaacttaaaaaaaaaatttaatctcagttttttccctaagcaaaccaaaacttaataataatatgacaacttgatcatataggtttttttaaaataaatcctcttattgtgacttacacagactgttcatgacatgcttggactttctggtttgtcctgaacatccctctttcttaagcaaccagtcattttactctaggactaaatttaccatacaagattctttcttatatgaaattatttatctttaagctttcttaccaaaaaaaacctctttatttttataactgtctttttttttttttttttttagatgaagtctggctgtcacccaggctagagtgcagtggcaagatctcagctcactgcaacctccgcttcctgggttcaagcaattctcctgcctcagctttccaagtagctgtgattacagtagcctaccaccacgcctggctaatttttgtatttttagtagagatgggattttaccatgttgaccaggctggtctcaaactcctgacctcaagtgatctgcctgcctcagcctcccaaagtgctgggattacaagtgtgagccactgctcccagccataactttctttacatctcttttattttcctggttccttttatattgttttaaacatgacctttaaataagctttgaattagacaaaaactattcatctttttaaaaatgacacactttttaaaaagaatgttttcttacaaatatatttttattggaaaatacccatataatgaaatatctattacttaatttaatataactttagattctaaattatgagtttgtctacaagtattacattcacctaattattttaattgttttagatgatttatgaaaactgtgatagtcatcatttaaagttatggaaccatcattgcaaaattataacagagacgtgaaaaagatttgcctaactgactccatcttgcttttaacctccaaactctccttgttcattcttcttttctctcctaggaaattgttgtttaaggatcctaattctagttcagagatgcattctaaagggtcttctttttcttcttgtcagctaatagtcttaaatttgcatattaaaggaaacaactcacataaaagtcagacagcaaaatttacctcgtaaggtacaaagtgaaagtctggtgagctggagggaaattaaaatgaatttaattaacaattggacataaaattatagacatctatcataaaggccttcaaatacatacatgtgtacatgtacatacacacatacacacatacagattctataacttttactccagtactttagccatgagataaatacaaatttgccagcttgcaagaaaaacccaaaaaactattagacccaaacagtggttttatctcagtggaaaaataacagcagacttaaagcatggcagaaaggaaaatagagaaaaacggactaggaactctagaatttgcaggttgaccttagggctctttttcctcaatgtaaatttgcacaaagactgtattacttccattttactctggcaaatagaggtgccataaaaccaataaggtgctctaaagggggtcattctccttgttttctcctcattctcagattgtttcctgcttctttttttttttcttaaaaggaagaattgagctgtggcctagggtttttgtgcatggatcgatgtgagctgcttgtgggcaggactccacagtgtgtcatcactgagttgtttccagcctcttatgcatctcagcttctctctccagaggtctatgtcctctgagagggctcaaaatgccaggtgatcagcccttatatgcatttcctggatgacccatttttaaaattaaatttttctggggatttccctgcagggccactgcatgttgcagggggtcaactccccagacgctcccacgaggcccctggtcacccagggacgcctttcgctggaaagagcaaatgtcctttctctttggagctcagaaaactcagtttctcatttgcctatgaaaacaacagttcagttcctcagacaaatgcacacagacaaacacaattgagattaattatgggagaaaaagcaatagataagaccctttagaatgcatctccgaactagaattaggatccttaaacaacaatttcctaggagagaagagaaaagaaaagaaaccagccaagaccacttcctgtaaactgtgctcagccacccgtaactttgtagttctcgtctgccattacatgctccaaggtcaaatcctctcacagtgcaaggtcatctctggttcccccaaagccaaagaggtcaggtcatgcaatacaggaaaacagagctttagatgtaagaagaatccgcccacgactcttgaaacttcacagagaaaacacaacactccaaaaggggtgagtggcccctttgttctgaattctttaaaggggttcaagtcattagaagccttctctagatttttttggtactgcagatggcaaagggggaaggaggtatagggtagaagaaaagtaaatgaaataaatattttttttttaagacaggaagcaaacacagaaagcaagtgcatgtttttgttgttgttgttgttgttttgtttgtttgttttagctgtgagaaattttggccagattagaaaggctttgttacccgtaatttggaattctcactcagattggaccaagtctggaagagtaggtcaaatctgatgggaaagcaaccagaacaaacaacaacaacaacaaaaccccaacaatatgatcactgagcactctaatggtaaaggagaaattcagaccagctggttgttaaactttagccaagacaaaaacccaactcagctacttacctagggatgggtctcaggctgaagactgctttttgtcatcctaaaagcaggaaaaaactcgaattcatcttccctgctgggagtgagctcaagctccctgaaggagttgtctgccttctatcgtcatggaaagaggaaatcttgccttccttgttggaagcaaataaaactccaaaaaaaaggtgggggggagttgtacagaaaaataaactctagatcttgaccaaatttggggagatcaaggattctctggagggtgtgctcccagacctcagcaaattgtcctattggtttgagccgtaaggttagctcatgctgctaccaaggaccagtagatctgtcaaaggtcaggggcatctccactcagaatccctccatggttaccaaaatgtgaacccccccaaatctgagacaagtctcagttaatttagaaagtttacttttccaagattgaagatgcacacctgtgacacagcctcaggaggtcctgatgacatgtgccaaggtggtcatacgttttagggagacatgagacatcaatcaacatatgtaagatgaacattgatttggcccagaaaggtggacaacttgaagcaaaagtgggacagggaggtgggttccaggtcacaagtaggtgagagacaaatggttacattcttttgagtttctgattagcctttccaaagaaggcaatcagatacacatttatctcagtgagcagggggatgactgaatagaatgggaggctgggttgccctaagctgttcccagcttgactttccctttagcttagtgatgtgggggccccaagatattttcctttcacacctgtttgaaatgcttgttccttggtgcagtaaagaaatagcacttgaacattgatttcctcagcaaggccatttttatactttctacagaaagggtacactcaccagcagttttgccgtgagcatacacagaacaaagcagacggggtcatttataacctgacacatccgccctactgctgtgtctggtttccattggctggaacaggacctcacattctgtatttgtcctgattggctagtaacttagaactttttaaaagaggcaaaggcagaggagaacaaaggaaggagaaagtaacttgtggaatgctgagaaaggtaaaaacaccttcaaataaggaagaggaacaggctatgacctaatgcttgcttggaccagtataagcacaccacggcaaatatttaggctaaattgtgggagctaagaacatatgatttctttattaaggctagcagattttaagaatgttagcacaggtctttgaataaattttgcttctaagagaagttactatttattcctaattagaggggaggaaagtctttgaagactcacctctactttacttttcacacctccttgaaggcagggactaaggactgtttccctcccaaaactaacgtgctaatttgcaaacagtacctccctgggttgaggagagtgtgctgagtgctgaataccctggcctgaggccttgtacctgaacagagaggaggtggttttacagtagggggagggagagagaatcttggtgcatgcagtgttgggagtgacctgatttccacagactgtctgtgttcaacctcacagccgaatgtttctccagttccaaagtcaacaaccagaacggtagaaggtggggaaaggttgaaggtggggctgagaatggctttgtctgaccccttaacccagtcccaactcctcagttggccctttctcctgggagtctcttgctactatctgtgtcagagttcactcgtgatgccctaaggggcagggcctttgggaaataaaggagaaaaagcacaaaccaaacaaataaattcttccttagcagggttgggaaagataagctgagatgtctcttttgggttaaccattggcttaatctgggttcccccaaatagcagagcctgagcaaggacttgtgtataggtagtttatttggggaatgaatctgttttgtatggttaaaataaggagaagatcaaagtatgagttcatgaatcacacagtttattgccatacaaagaggtctttctttttcacaattcttaaaaagggggagaataatgagaacaaatctcacaggggatacactcaacagacaaggtacattaatcacataatgaatgagttccaatttcatttagagtccaattattaaagttcagttgaagctgagcatggtggctcatgcctgtaatcccagcactttgggaggctgaggtgggcagatcatctgaggtcaggagttcaagaccaccctggccaacatggtgaaaccccatctctactaaaaatacaaaaattagctgggcgtggtggcgggcacctgtcccagctacttgggaggctaaggcaggagaatcgcttgaaccctggaggcggaggttgcagtgagccgagatcgcaccattgcactccagcctgggtaacaagagtgagattccatctcaaaaaaaaaaaaaaaaaagttcaattgcccacttaggatggaaagcaggcttttgtggatgcaaagtccaatcagagtttgaggcactactttctaggagaggttctcgggagggacagcttgactaatacaatggagatccatgaagatacgtgaggtctcttgctgctagagagcggtgccagtgttgtgagacaaggcttcaaaaacagcttcaaggcttccagagagtggcctcgccacatcctaagctctccaagcgtctgtcaaaatcctgggtttctatgtgtttggagtccagtggttgaggtcagtagctcccatgcggggtctgataaggtgtgacatgacattcccttggctagggagagttccctgcatgttctaatcacagtaaaacaatatcactctcacagaaaagtgaaagtgttcggaatcatttaaagctacataacaaaatcccaaggaattggaggggagggctgggaagagtcaaatagggaaggagggaaagagaatggcatccaagggtgtattcgtgagttgatcaagtcggtcactactatgggcaaacagaatgctatcattttaggagctgcatagaacatatctcagaattgcccactggaagactggaagagcagagtatttttcctgcagttcctgcctgccctttggtcaaagtttgtcctttgaggtgttcctttgcacttccaggtttactcatgtgtcagagtggacagcggattcctgcaagggtcccaggttgcagtgccagagacgcagaataccaggtgcagctgaggcaaggtgctctcaggttacacctgttcatacctggttgtcacagcaaagctgggctgggaagatgtaaggccagatgtgtaatacaacctcagaaaggtcaaatgtccttttctgtcttatgcaaataggactacaattcagtttaattctcagagtcaggatctatgttttttcccttggggtaaagaagaattcttcctttaactacttttctagcaaagcataatcctcaaggcgtaattttagtatagtgatttatttttaaccctgtggtactatatgcctaatgttctgaaacaccgtcactggagcaaatccaggcttgagtctatctgtgaaacgggaacagaaaactaagtgcatcctcccttcctgattctcccagtcttcaaggctgtatgtgccaggagctggggataaaggagatagccttagctctccagaagctcacagaatggacagacagagccaacagttttatttgtttgtttgttttttgagacagtctcccactgttgcccaggctggaatgcagtggcaccatctcagctcactgcaacctctgcctcccaggcttaagcaattcttctgcctcagcctcccacctagctgggattacaagcatccactacgaagggcagggtttcaccacattggccaggctggtctcaaactcctggcctaaagtgatccacccgcctcagcctcctacagtgctgggattataggcgtgagccaccgcacccggtctacagttttctttaaatcttcatcatgccagtacttccctcctcctgttttcatcttcctgtatttgcaagtttcattcattctcttcattctattcattccttctctgtactttacctaaacatagttgtgaacccccaaaatctgagccagatcaatttaggaagtttattttcccaaagttaagaatgcacgcaagtgaaatggcctcaggaagtcctgacatgtgcctaaggtggttgggacacagctcggttttatacattttagggagacatgagacatcaatcaacatatgtaagatgaacattggctcagtctggaaaggtgggacaactcgaagcaaggagggagcccccaggttataggtagatgagagacaaatggtcgcattctttcgagtttctgatgagcctctccaaagggggaatcagatatgcatttatctcagtgagcagggggtgattttgagtagaatgggggcaggttggccctaagccgttcccagcttgactttcccctttagcctagtgatttgggggccccaaggtttattttcctttcgcgtagcttcgccactaatgtgtcctggtgtcttctctcctcagcctgtttctcatcctggaaactgaggtgtgctggcgcagggcgatagcgcagtggggtggggttgggaggaaacccttatctgtggccgatggccctccgttgttctattattaaaactctgggaaactgctattcttaatttatttttaaagaccctgagaagcaaatctttaatttttttgtttttgtgagacggagcactctgtcgcccaggctagagtgcaatggtgcaatctcggctcactggaacctccgcctcctgggttcaagcgattctcctgcctcagcctcccgagtagctgggattacaggcgtgcgccaccgcgccctgctaacttttgtatttttagtagagactggttttcaccatgttggccaggctggtctcgaactcctgaccccaagtgatccacctgcctcagcctcccaaagtgctggaattacaggcgtgagccaccgcccccggcctttaaataaattcatctgatcaaaagaaatttaaaaaccaaccaaccctaatgagctctaaagacagcaacacgcacaggacctggaaagagcctcttcctcaccggagttttcctcacttcaaggagcggcgccttcaccctccggcctcagcccgcgaggctgcaaccctttccgcacctggctccatctccctggccctcgcccccgcccagcggtcggggagcgagaaggcggcgggggatctggcgcccggcttaggggcgagacggccgcaccgggagcctagcgatcagggcaccttgggcgggaggagcgccagccgggcacccagcgcggaggaggcggctcggcggccccccgacagccacgccgccgtgagccccgcccagcgtagccccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttgggtaagaggaggggtccgcgtctctgcagctcgggcgggattccctggcgccctctactcggtttggttcggcctcacgtgttcctttagctccgaagccgggatacgggtggggaaggggggctcgcgccctacaggccgagccctgcggccgcagcggggtaagggtaggatggccgatcgcgcccagaccccagggagtctccctctcggcttttctgccggcgtctccagcagcatgatctggcatttattattcggaataatgtgccaggcaggaggaggccctgggttaaacacgcggccctgcagctcccaggtgaaacgactcatcgtttcctgccggcgcatcttactgaaggggacccaggccccacgaagggaaggaaccgtcctcaaggtcacgtcgtagtcaaaggccgagcccagaccgaagccaggtgtcctgccttctagccccgggctctaggccctgtccccttcccgaccgaatctcccagtcccgtccgcgtccctcctcctcctcctcctccggggtcctccgcaaggctctgttcccggggtttggggagtcctccctccgcgccacagcgccctggggaagaatgctggacagcaggcaggccacagggccggggaaggaggaggagccgcggggacaggctggggatgccagagtggtggtgggcccgggactggccagggtgggagtccaggcggcgcacccgcgcgaggacaagggggctttggctgggcggtgctgtctcaaccaatgggaagcgtggctctggccgagcccccctctctccccgccctccggccggccgttggggagcgctgctctgggattggctgcgccgccgtctcgggcgttctcgcgctctgcttacgtgctgacgcgcgcctgatagataccctgtgggtttgagcgctccggtcggtccctagcggcccaggcgccttgggcgtgcgtcctgcgcgcggccgcctccaggctgcgcccttctggggaagtgtttggtgctgcgcgcggcgtcgaactccgcgttttttttttttcttttccagccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctggtcagtgtccttctttctacaagaggcgttggagccgggctctgcatagggcgtatatatccctggccgccaaggaagctgacccttgaaatttgtgaagctttcatattcactcaatacacatttacagagcctctacttcctgtcaggcgtcacacaataaatattcggaggagcaagaagagagtgattcaacatttgggtcttgtctgtagggtgctcacagtccgggtggggattggtggtaggatgggggcttgtgaatgtttataaacagaaatccctcgaatacgaccctggctaggtaggtgcagttacagaggcacagaagggaggagattgggcgaaagatttttgaattaggggattagaaaaggctgctcgggagagttatctgaaccagctaggacttggtcagatgcagtcagtttggtataggatgagcaaggctcgaaaattggaaagtacagggcttgttgagggatggtgtagcaaacggttgaatgagtagaggagaaaagtatagttggagatacggtttggaggagccaggtgaggactcgggggctcagcttgtgtcctcgggtttgaaatgcagtaagcacttgtgaatagaaaggctgcttaatcatttgcactactgtcatttgttacacctagaccaaacatcttggaaatggctttgattcttccttctttcatatcctacactcaatctgttggtaaatggtagcggactctaccttcaatataaagccagacttaccaattctaatcagttccatggttttcaccaaggctggtgtacatttctaaggaacacgttttcacatctcactgcagtggtgcaatatacaaccctcatgactgcacatggtggccctggattactgccacagatcctaatgggtctccctgcttctgctctagtccatcctcaacttattaacccagtgagagttacctttttaaaaatgtaagtctgataatggcactcctcttcttaaaactcttctttttttttttttttttttgagacagagtcttgctctgttgccaggctggagtgcagtggcgtgatctcggctcactgcaatctccacctcctgggttcaagtaattctcctgcctcagcctcccaagtagctgggactacaggcgcgagcgaccacacccagctaatttttgtatttttagtagagacggggtttcaccatgttggccaggatggtctcgatctcttgacctcgtgatctgcccacctcggcctcccaaagtgctgggattacaggcgtgagccaccacacccagccaaaactctcttaattcatttaattatgtaccagccaggcgtggtggcacacacctgtaatctcagcactttgggaggccgaggtgggcagatcatttgaggttaggagtttgagaccagccgggccaacatggtgaaactccgtctctactaaaaatacaaaaattagccaggcatggcggtgcatgcttgtaaccccagttacttgggaggctgaggcaggaggattgcttgaacctgagaggtggaggttgcagtgagccaagattgcacccctgcactccagcctgggtaacagaacgagattccatctcaatgaatcaatcaatcaatattgtgtgtctgttgtgtgcagggcactgctgtacatgttggagatacaacagtgaacaaaacagacaaaaattcctgttctcaaagagcttatattctaatgagactgaacaacaacaaacaagataaatatgtacaacatgtagaatgctataatgtaataaagtgccaaggaggaggaaaaaatggaagcagagaagggggatagtcagggttggggtgggatagatggggtggccagagaatgtcttagtaaacattttagtaaaggactgtggatattgagggaagagtgttctaggtagagggaacagtaaggacaaaggccctgaagcaggagctggcttgctatgttccaaagacagcaagaaagccactgtgaccaaagtgcagtgaaccaggtaggaatgaggtcagagggacaatggagacccagaacatggagggccttgtaggcaaactctagattttggcttttactctggcaggagtttggtgaggcgtgacatgatctgatttatgttccgcaagatcctgcaggctgtgttgaccagaatctggaggaactacagtggaagcggagagtctagttgggaggctactgcaataatccaggcaagaagggatgaaggcttggactaggctggtagcggaggatcctagatatatgtgaaggtggcattgataggacttgccgagcactgggccgtggagtgtgcaggaaaggggagtcaagaatgaggaagatttagaggaacaggtctgcaggacaatagcacaggctcagttttgcacaggttgcatttgagatacgtagtaaacattcaagtggagatgttagatgcgcagttgtctgagttcaggggagaaggttgggttggagatcaaccttcgggagttggcggcatgtgaatcgtatttaaagctatgagtgctcgtcatggtgcggagaacagaccaagaacagagtcctgagactccgttgtttagtggcctgcctttaatttggtaggcaagccctgttctcctagtgaaaaaatgcccacttgatctggcagttgtaattatggcagttttgacagctcgggtaacactttgtcttggggaaggacagaagaggagtggaatgggggaagcacaggttccagtgtcgttataaggtcattataaatgaggcattctcagaataggggtcaaaactgagaattaatacacctcatatgctgttggtgggaatgtaaattagtacaaccactacagagaatagtttgtaggttcctccaaaaacaaaaaatagagctaccataggatccagcagtgccactgctgggtatatacccaaaaggaaggaaatcagtatattgaagagatatctgcactcccatgttggttccagcactttttacaatagctaagatttggaagcaacctaactgtccatcagcagataaatggataaagaaaatgtggtacatatacacaatggagtagtattcagccagaaaaaaagaatgagatctgtcatttgcaacaacgtggatggaactggaggtcattatgttaagtgaaataagccaggcacagaaagacaagctttgcatgttctcacttatttgtaggagctaaaaattaaaacaattgaactcatggagatgtagtagaatgatggttaccagaggctgggacaggtagtgagggtctgtgcagtggggagaagatgggatggtcaatgggtaccaaaaagttaaagagaatgaataagaactagtatttgctagcataacacagcgactatagtcaatgatcatttaattgcacatataaaaataactaaaagagtataattggattgtttgtaacacaaaggagaaatgcttgagggggtggatactccattttccctcaggtgattattacacattgtatgcctatatcaaaatagtaccccgtaaatatatagaactacgacctacccataaaaataaaaagttaaaaataatagtgttctgccttcagttttagctactattgatttggtggcaagtggcagaaacgtccagcctgcttaaattacacagagactgtaaaggcacagcatggcttctggagctggggggcagatgggaggcggctgctgctgctgttgcttttctccctccctccctccacctccacccctgctgctttctgcatgagcatcttatccccccaccccctgcagatcggctttctccctctctctgtggcttcagggcccagtggagtgtagctgccgtcctccagcagcgccattgcatggccctgcgccacagagcatggttcgcattctctcacggtgccaggggacagaacaatgggctcaccttgggtctggtgtctcttcctggctcagtcctccgtgaccaaagcatagtctctgcagctgcagaggccaaatcctatgagggaggggcaggtctgagaggaggggacatcaggtgagcaggacagacccccgaaaggtagtcactgcagagtgtatgtggtgtgttatcggaggagaactggtcgccaccgaagcctaatctggtgactggaatgtctctcaggacgatcaaggtgtctgcattgggtgtgcctaatgttagacccttggcttttattgaaggtccctgtgaaacgagccatgtgagtgtcatctctgcatgtatgatacagtggtggtgagaacactgtctactatatcacttgatgttcctgtgtaattatttctgacttttgtttgagaatggttacttctctaaggaatgttaggtgtctttttgaatgagggcttgagaacttgtcaggtttcccgtttgcatgacctcaaggaagctcccacgtatagctgagctgggttggaactttcaagcaagactctacgaaatgttcggaagaggaatggccaaatatatatataatagttatttgattatagtgcatatatagatatatatggtcaggaatctcaaaactcaaatgcccatagtgtccaggcaattaacaaagatgatatggatagttttaacatagtaagtacaaactgtttgtattgagttcaagcatagcttagctgcctagttacactgctttttaaaacagcaggctggccaaacaaatcagccaagtagaacatgtttaggtaggctgccagttgtaggatttgggaagctgacacagaaacttgctggtctgaagctcttcagtgtgaggtctctgcattggctgtttccctgcataaccccagcttgccctcctcgggggcaggacctttgcctcccacttgggagtggcaagggcccatgtaggcttcatgtccagaaacacctgagttctctttcctgccttgtgtgacccggtttgctgcggataccttgcctctgctgagaatgttagtactgggaatgcctgcccctttgaggggagcccctgctgctgcctcacaggaaagcccccagctgtgacctctgcaagatggtcatgttggaatggaacacagtgagcccagcagtgaggaaggatgcgcacgctgttttctttttttctggagtaggagtgctttccatgtgttataccttgacagtggagcgggcccttgagagaagccccaagtgtttctagcattaaaaaatgtctccaagattccaggttgatatgtgagcatcgtgattttgtgacagtatcttatgagtttggtccctgggagtcaagccccctgtgctcagtcacctcagggcaactaattacttgactttcaaggctgaggagactgagcacccgcctcccacagccatttctgttcccaaactaaaaggcaagaaagtggtgtgtgaagtttgagaacttaatatttacagagaataaggcctggcacaaaacatgaagatggcagacagctaccctgaagagtctttgggagccctgcagtggaaatagctgcatgtttaagaaacacgcatgcaacagactacattgagaacagtgcattgttcaagggactgagttttttgtgttttttttgtttttttttgttatttttgtttttgagacggagccttgctctgtcacccaggctggagtgcagtggcgtgatctcagctcactgcaacctccgcctcctgggttcaagcgattctcctgccccagcctcccgagtagctgggactgtgggcgcccgccaccacgcctggctattttttgtatttttagtagagacagggtttcaccatgtcagccaggctggtctcgaactcatgacctcaggtgatccacctgcctcagcctcccaaagtgctgggattacaggcgtgagccaccacgcctggccaagggactgagtttttatgcacttttaattattttggctttagtacttttagatatggctgacttcaaggaaaacaaaatggaaagcagctgtctatttggagatcatattaaagcattttctgccacaggcattgagctaaggggtggaaaggactttaattatagatgactggatgggaagtttcccagtgatggtgacctcagactctggtcctgggtcttggagggaggaggtagagatgtgtgtgcttagccagctggtcagtacttagatggtgggagggggtgcctcatgaaaaagtctgagccaacgtgggcctgtgccttccataaaaccataaaaagccagtctgggctccattctgctgctctctgcaaggagctttccatggaaacttcttttgtggccacaggccgactttccacccccagactgccctgcgggagcccgctcagctcccatccactccccagggactcagagtgcctcctttgcgtcaggctcgttctaggcactgaggatttggtggtgaaccaggtggagaggattcctggtgtcactgagcttaggatctagtagaagataaagtaaataaacataattttgaattaaggtagctgctatgagagtgatcttacagagagcaacctgtgtgttgaatgggagccactttagtgagggagacagaggactcagcatccaggatgagggcagagcaggagccggtactctgaggcaggaacgccctcacgtgggcaaggagttcttggagtcagtggtggctgcgacgcagtgagcaaagaggagggtggcccagtgagctaggggcctccagggagggagaggccagcccccacgggcatggaaagttggctttaaacacggaagtcgcatagcttgaccggtgttaaaaaggtttcttgggctgctgtgctgagaatgggggtgtggcaaataggggcaggagtacaagcgagagtttactgtagttctggaaaggtaacaccagagaggtttctgcctgctttcctttcctgaggattaaacagattaaacgcctccacctgcttccagcagagtgcatggcagtggttgctcagttaacactgctgacctctgggcccaggtggctggttatcagtaaggtttggggtggcagcaaacaggcaggggaggagcctcccaggcagtaccttattaccaggaacagtatgacagactacagccaggtaggcaaaggagaggctggaacccatttaccagcccgccttccttcccttaggcctggaggaatcactattaacagaacaggagggcaacgcatgcccgtgctgatcagcggtcaataatgctgaagagtcgtggtgcctagcagccttaaggtgttaccaagagattcttgttgcaataaggttgctttaacctcaaatggtgagggagcggggagggtgtgtgtgtgtgtgttaattacaagagtctcttatttggcagctccaaactctatgctataatgaattactgattaattcagcctcagagccagagcccccttgtttgttcgcatgggggaaagaggtggacggctgagtcagatgctatgtggcatgaggacaagctgcctgcaggggcaggtgggcacctcaggaatgaaggctgatgccctggggcaccacaggtgggtgtttcagcaggttagaggaataggacttaccgagtcagaatccctgaggggttaggtccccgagtctcccagtggttggcgggtttgaggatcactgatctgggccaacctgctcacattatgaatgggtgatgacttgcccagggttgcccagtgtgtttggtggcacagctagagccagaacccaggcttccaggcaccctggctcctgactctttccattgtgaagctgcagcttgagagaggaaccagagtggactacctggtggtaccaggactggagctgggtggaacagatgcagcccagtttgactttcacaacctgaaaggaacatgactgctcctgattaaagcccggaaggcaacaaagtaatgctgagggtgcatttatgtttcagaaccaccgggaggaactgggccattctaacacccgttgctaccatgctggccacccgcctctccagacccctgtcacggctcccaggaaaaaccctaagtgcctgtgatagagaaaatggagcaaggtaagcaaccagaggtggtggtggccttgaggggacactttctgagcaggcagaggttttcacacatggacagtgtaggcggtgatgaggcctgattctcagagatgtctctcaatacctttgtctcccagcagaggaaactcagaggtgtcctgggaagacattttcccagggcacacagggcagaaaggaatatctttcataaccacttatttttttttctttttgatggagtctcactctgttgccaggctggagtgcagtggcgtgatctcggctcactgccacctccgcctcctgggttcaagtgattctcccacgtcagcctcctgagtagctgggattacaggcacctgccaccatgcccagctaatttttatatttttagtagagacggggtttcaccaggttggccaggctggtcttgaactcctgacctcaggtgatccacccgccttggcctcccaaagtgctaggtttacaggcatgagccactgtgcctggccataaccacttcttaaaaccctttttattttgaaataactttggacttatacaaaagttgcaaaaatcgttggaaagggtttctggatccccttcagctaacttccctaaatgttaacatcttacaaaaccatactgcaatgatcaaaatcaggaaattaccattgatagaatactattaactagtctacagaccttattccagtgttgccaagtggctgctgatggacctttttctggtccaggatcgaatcccaaatcccacatggctcggaggtgtcatgtgtttttagtttcttcctgccggggacaggtcttcagtctttttcgctcacgaccttgacactctcgctggttatgttgtacaatgtctctcagtttgggtttgtgtggcaagacgcctgcggcagtgaagcggtgcttttctcagcccgtcgtgccaggaggtacattattttgataactgctcttttaaaactttatgcatgaaatcagttagccgagatgtcccaaaccttcaccgcatcgtttgtgtgatttcgaggaagcattatataagtacaaattagacaagcagctgttcttctttgagagcttctggaattgccttttcccaggggattcagtgggctctgctgccacattttactcttttgcagtctgagcaaggaaaaaacaagaaatacctttttctttctgttatatttgaggggagtgaatttgaggggagtgaaattgaagattatgttaaattcaaagtcccaggatctagaacactgatatttctatgccaataatatgtttaatggaacatgcatttagactgagactctgttgcccaggcaatgtggcaacctcttggctcagagcaacctctgcctcccgggttcaagcaattctcccgcctcagcctcccaagtagctgggactacaggcatgtgccaccacacccggctaattttttgtatttttagtagagatggggttttgccatgttggccaggctggtcttgaactcctgacttcaactgatccgcctgcctcggcctcccaaagtgctgggattcaccacgcccggcccggcttttagcagcatttgcttgaatttatttctgagagatacagaggcatggcttggagctggggctccacctacctgaggaccccacatgagaagagtttagaatgccccattggcacaggcggcaggaggcccctgccatcacagcggggacggcggaggcccctgccatcagagcggggacggagctcggctttgttgaagggcttttgaaagaaggtgacttgctgcaattgttttttcagtgagtgattcataaagatggcaagatctgtctccaacatggcttttagagatttctggagtttttttatagaggagaagataatcccacatgaagttaaaatacttttacaaaggttttgttcttaaatgtaaggaaaatgaggcattagtcaagctcctggctcacttgaggggaaagaaagattgtcaaagggaatttggaatcttctggatggactgagaagtaacttggttaggttgaggggcctgggtggtggttgggcagccgcagagctgtcagagtagagtcaatgtcgtagggtgaaggtatgggcagcgtggagggggacccaggtacagaaggaggctggcatggtgggtaatcgccatgcctaggatcccacagtccctcagagggaaaactttggcctgatcattttgcttgagtctcagttggaaagggcctcatactccagtctgcacctgtgagtgaatcttgctgatagcatccttaccaagtgactttatcgcctctgtttgaatatgtccagtgatggagaggttagtacctctcatagcaggcctcctgtgtttggacatctccttattgaggagaaatcttttctcctgttaatgccactccttgttcttgggtctgcccctgcattcacactgagcgagttattcccttctccccaggggcactgtgccacctcaatacccacccacttgtctactcttactccacccacatggtttctccttgtttatctctcatggtttccccactatcatccaggtctccccgctgaatggtctgcactttgcctgtgctccttcttaaggtgtggtgcctgaacaaaacacccaccactcttgacatgcccagagcaggcatcacccagtacacatggctccgtccagatgaaaaccttcccaggagtggctggataaggcccccaaccccaacacttgacaacctgctgtgcttactggctccccatggccctccgatttcagatttctcagatttctggctttgccagaagactctggcatccctggggcaggtgccttgctcacatctgggaccctgcctcctgggctgtgatcaccagtgctcagctctgccaggccaggtacagcacatagtgctcccagggtggcctgacccgggcagagtggagaagggctcttgcctcccctatcctagtttctttcctgtccagcctaggctcacatagcttcttttggctgccacatcacatgcgggattcatggtcaaacaggctaaatttttttcacagatgctgccgtgaggccatatttctcccgagctgcacctgtgccactgatatgtgttcctcctaagccccgtcttgttagattcaaatggactcatggctcctctcagcagaaagctgggttactggttattgtttctgattcctgatggggacaataaaaggcacagacacacagactggtaagatagagaagaagccagaatgaacgccctggccagcatagggagcgctctcaaatgcggccgggatgaccagggcgctgaggacagcaggctcttccacagggccttggggaggtgccagactgcaccacttcctccctctcattctgttcctgggttagggcaaaaatcaggaagctctcgtcttctgaacctcacagccacccctttgggctctcccttcagaaagtgtgttgaccggtgggggcgcggtggctcacacgtgtaatcccagcactttgggaggctgaggcgggcggatcacctgaggtcgggagtttgagaccaacctgtccaacatggagaagccccgtctctaataaaaatacaaaattagccgggcctgtggcgtgtgcctgtaatcctagctacttgggaggctgaggcgggagaatcgcttgaacccgggaggaagaggttgcggtgagccgagatcgtgccattgcactccagcctgggcgacaagagcaaaactccgtctcaaaaaaaaaaaaaaaaaaagcaagcaagaaagaaagcgtgttgaccatctcgagcttaacttgtgcctcccgagagactgagaccggcatagctgttggtgttagtggcttggttggccagcagcttgctgttactgcaggaccctcctgggcagaggagaccctccagggaaatacacactattttatgtgctggttttgggcctaacgcctcatgggcattcttagccctgggagaccagtgtatgagctgggattgcctcacactaagaatagcaggaacccctagaagtctagggccattgtggctttggggagcccaggctccttgtttttttctgctgtgttattctgaaggcagctcaggatcccaggatactgtgatagtccttcacctccagcctcagtccaggcagggacaagcaacgcacctgcatcgggaaagcaaaactcagcaattgtggtcgacctccgcttgcagcctattggccagaggcaggtcacgtgaccactaggtgggtggtaatctggaaagcgttgggcgcactgctgtccctggacaaaatccagattcttgttagtgaggcagatgagaagaacggatgctggcaggcaaagagcagtgtctgtcacagctcagctgggctgtggcctccagctgttcacagggatattggggctttggcattcaaggggctcaaaggggaaccccctggggataggtctttgtttttcttttcctgtagggcagtggtattgaaccttggttgtgggttagaatcacctagagaacagtgagggaaaaagtgtctgtgcctcacctctgggtcaggagtgaggctaggcaaaggaatactttaaagaacttccctgtgattaaaaagaaaaaaaaaatcattctatggagaatctcaaacatacgcaaaagtagaaagctgtatattgatccctggtgtacctgtcacctgggtttccataattatcagcacatggccaatcttgtttcagctacatctccattttcctccccctccccataccagattaattttcgaagcaattcctggacatggtatttcatttgcaaatattttaatatttatctctaaatgataagaactcgttttagtaatataaccacacgaccatgatcacatttccaagtgattctaataaacaggggcccagagaacaactgctgtggactagatgaaccagttcttcccccaggacctgttgcactggaatcccctgaggtgaatgacacaggcagatttctggggccaccccttcctactgaatcagaatgtcaacgggagggacctgggagtttgcattttaacaagctccccaagtgcttgttaactaacttttgagagctgaggcagtaaggtcttcctggtcccaaggccccttcaaattgagaagcagccctaagatggggatcccacagcgactgtaagagctgcaaattgagggaagaggaattagagtaggatgaggcaatcccagcagtggccaagaaggaaaggccgagaagtccagcagtgctcaggaggcactgtcatgctagctggagctgcccgcccaggagtattcacagccccaccttacccaccttgtcagggtattgctgtggggggggcaggtgagtcgagatagaaccttctgctctctggaagagtagaaatgcgccattgactgttgggtataagtggtagagcctggtataatacacccagactcagttaattttaggtctgaatatatttgacaatggagagacagtttagagaaagacgggcagcaagtcaatctgaaataagctctcttgcctagacctttttgttacttgttttgttttgtttttgttttaagacaggtctcactctcgcccaggctggagtacagtggcacaatcttggctcactgcaacttctgcttcccgggctcaaatgattctcctgcctcagcctcctgagtagctgggattataggcgtgtgccaccacgccctgctaatttttgtatttttagtagagatggggtttcaccatgttggccaggctggtctcgaactcctggcctcaagtgtctgcccgcctcagcctcccaaagtgctgggattacaggtgtgagccaccgctcccggccacaacctttttgttacttttaaaaatgtcaggtaggctgggcatggtggttcacacctgtaatcccagcactttgggaggcagaggcaggtggatcacttgaggccaggagttcgagaccagcctggccaacatggtgaaacctcatctctaccaaaaacacaaaatttagcagggcgtggtggaacatgcctataataatcccagctacttgggagccagaggcacgagaattgcttgaacccgggaggcggaggttgcagtgagccaaggttgtgccacagcactccagtctgggtgaaagagagagacgctgtctaaaaaaaaaagtgctaagggtgtggcccttaaggagacaggaacaaatcatctagttccactagggatgtaactgcccaatggcttcaccttgctcactgcctagacagaaccggtttatcaagacagaggacttgcagtagacaaagagtaattcacgcagagccggctgtgcaagagaccagagttttattattactcaaatcagtctctccaaacattcaggaatcaagagtttttaaggataatttggtgggtgggggaaggccagtgacagagtgttgattggttgggccggagaggaaatcatgggaaattgaagctgtcttcttgcgctgagtcagttcctgggtcggggccacaagagcagatgagccagtttgtccacctgggtggtgccagctgatccatccagtgcagggtctgcaaagtatcccaagcgctgatcttaggagcagtgtagggagggtcagaatcttgtagcctctagctgcatggctataaattatggtttataatttgtaatctggtgcctaatttgttagtcctacaaagacagtctgatccccaggcaagaaggaggtttgttttgggaaagggctgccatctttgttttaaactataaactatagtctgggcgtggtggctcacacctgtaatcccagcactttgggaggctgaggtgggcggaacacctgaggtcaggagttcgagaccagcctggccaacatggcaaaaccctgtctctactgaaaatacaaaacttagccaggcgtggtggtgggtgcctgtaatcccagccacttgggaagctgaagcaggagaattgcttgaacccaggttgcagcgagccaagatcgcgccactgcactctagcctgggtgacaagagtggaactttatctcaaaaaaatataactcatctcaaatataactccatctcaaaaaaacacaactgtaaactaagttcctcccaaagctagctcagcccacagccaggaatgaaaaaggacggcttggaggttagaagcaagatggagttggttaggtcagctctctttcactgtctcagtgttttgcaatggtggtttcaatgacaccttctcattctttctgcagagcaacactgggggtcatgggaatacagactgatgctctttggatggagtcattcacaagctttgggtgtaccgaccacactatcctgatcacttgagaccatccgtgcacaaggacttaaaatccagactcctctgtggcagtacaaaaggacagggggttaccttggcaggttttcctagtgaaccctcatttctgtctagtgaatttaatgttctttaagaacatattttaataattttttaaaagcttaatatgttgaataggtaatatatttacatggtacaaaatttgaatggcaggccgggcgccgtggctcatgcctgtgatcccagtactttgggaggccgaggcaggcggatcacctgaggtcaggagttcgagaccagtgtggccaacatggtgaacccccgtctctactaaaaatacaaaaattggccaggtgtggtgatgcaagcctgtagtcccggctactcaggaggctgaggcaggagaatcgcttgaacccaggaggcggaggttgcagtgagctgagatcgtgtcactgcactccagcctgggcaacaagagtgaaactctgtctcaaaaacaaaacaaaacaaaacaaaaaacaaaatttgaatggcgtcaaatggtatacagaaaaggtaagtctatctcccatctcttttcccctgttaccacctgctcattcacccctacctccttcatttgtcattactgggttaatatcctttaaaaactaacaggacctccgcttctgggaagatggagtagatgtacttttctctattctttctgtcaagtacaactaaaaaccctggatattacataaattataaataatttagtaagtatgtaatatataaaaagcctcttaaaaggcagagagaagaaggcagaccagctaaggacctcaggacccaagaaatggtgcagtgatgagttctctaggttttctttttgtttcttatgtcccagacttggagttgaagcagccggcaacccagaaataccagtaagctcagacgcaaaaagccccaacaaaaatttgctctctctagccaaatgaccagtgcagtaggacagaacaagtgggtttgttccagggatataaggatggttcattatttgaaaattaatctcatccaccaaattaatgaactaaaagaagaaaacttacatgatgctctctatcaatgcagaagatgcaaaatttagcacacatttatgattttaaaaatctcaggaaaaatagacatagagggggattttcctgaacttgataaagggtaaacaccataagccttcagctaacatacttaagggtgagactgaatgctttgtccctaagatggggaacaaaccaaggatattagttctcaccgcttatccaacatagtgctgtaatttctagccagtgcaataaggtaagaaatggaagtaaaagtcatatagattggaaaagaaggaataagaccccatatttgcagattacatgattgtgtacatagaagatcccaaggcatccacaaaaaaactcctagaactaataagtaagtttagcagggttacaagatacaagataacacacaaaaatcaattgcatttctgtatactagcaatgaacatatggatatcaaattttaaaacaatacagtttcgaccggatgtggtagttcatgcctgtaatcccagcactttgggaggatgaggtgggaggatcacttgagtccaggagttcaagatcagcctgggcaacatggtgagaccctgtctctgcaaaaaatacaaaaattagctgaacctggtggtgcatgcctgtagtcccagctactggggaggctgaggtggaaagattgcttgagtgtggcaggcggaggctgcagtgagccgagatcatgctaccgcactccagcctaggcaacagagtgagaccctgtctcaaaaaataaaataaaatgaaataaaataaaacaaaacaaaacaataccatttgtagttgctcaaaaaaagagagaaatagatgtaacaaacatgttacacataacacagcatgtgtaggatttgttttttgttttgtttttgtttgtttggttgggtttttttgagacggagtttcactcttgttgcccaggctgcagtgcaatggtgcgatctcggctcactttgacctccgcctcctgggttcaagtgattcttctgcctcagcctcccgaggagctgggattacaggcaccccctcaccatgcccggctggttttttgtatttttagtagagtcagggtttcaccatgtcggccaggctggtcttgaactcctgacctcagttgatccacctgcctcggcctcccaaagtgctggggttacagggatgacccaccatgcccggccgcatgtatggtttaaatgctgaaaacgacacaacactgatgaaagaaatcaaagatctatgtaaatggaaaccccatactgtactcaggaattggaagactcaacaaagtaaagatgccaactttccccaaattgatatacaggtttagcacactttctataaaaatcccagtcatattttttatagatgaagacaagattactctaaaatttatatggaaaggcaaaggaaatagaatagctaaaagaattttgaagaagaaaaataaagtagcagcacatatatcaatgaatcaaaatagaaaatccagaaataggcccacccaaatatgcccaaccaatttttgacaaaagtgcaaaagcaattcaatagaggaaagataacgttttcaaaaaatggcgctggagcaaatggacacaaaacttagacctaagtctgacgtcttatacaaaaattaatggatcatagacttaagaagtaaaacataaaactataaaactttttttttttttgagacagggtctccctcagtcccccaggctggagtgcagtggtgcaatctcagctcattgcaacctctgcctcctgggctcagttgatcttcctgcctcagccttccaagtagctgggacttaaaggcgtgagccaccacacctgactaattttcgtattttttgtagagatggggtttcgccatgttgcccgggctgttctcgaactcctgagctcaagcaatctgcccacctcagcctcccaaagcgctgggattacaggcatgagccaccatcccagccaaaactataaaacttttagaaaagaacatagaagaaaatctttgggtcctgggggcaaagagctctgagacttgacatcaaaagcatgccgcataataggaaaatactagactttatttaggggttaagagtttagactctggactctctcagccttggtttcactagttagctctatcactaactacattgggcattgaaaattcctctgttgtcccacgtggtgcatggatgattgtagacgaggacactgagatcctgaaggcagaagtaatttctctaagcaacgttgttggttggtggcagagtctgggttacaacccctggtttcctgattccgagtccaagtgaaatacttttgcccctgcagtagaccctgctacagaggataaaaaggcacgtcataggctaggagaaaaattttgcctaccacatatgtaaccaaggactagcagctaggacatctgaagaattctcaacattcaacggggtagaagaatgaacgattcaatagaatatgggcaaaagacatgaagaggcattttaccaaacatagggtgctatggtccgaatgtttgcattctcctcaaattcctgtgttgaaatcctaacccccaaggtattggtattaggaggcaggggccctgggaagtgattaggtcataaaggtggagtcctcatggatgggattagtgtctttataaaagagacctttgccatgtgaggttacagtgagaagacatctgtctatgaagaaagtgggccctcaccaaacacagtctgctggcactttgcacttcaactccccagcttccagaactgtaaggaatataagtctgttgttggtaagccacccggtctatgatattttgttatagcagcccaaacagactaagacaggtgacaaataaacatgaaaagatgttcaacatcattagccattagggaaatgcagattaaaaccacagcgaaatatcatgatacagttttcagcatggctaaactagaaaatagtgacaccaccaaatgccgacaaggctgtggggaaactgggttgttcagacactgccactggggctgtagcgtactatagccactttcataaacagtttgtcagtttcttaaaaaactaaacctgcaactaccatatgacccagcaattacacccctgggcacctacccaagagaaatgaaaactcaacgtttgcgcaaaaacctgtgtaggaatgttcaagcagctttattcataatatgcccaaacaggaaacaactcagctgtccttcagtaggtaaatagttaagcaaattgtcatacccctgtgtcatggagcactacctagcaataacaaggagcaaattattgatacataacaatctggatgaatctccagagaattatgttgaatgaaaaaagccagcccctgaaggatacatactgtatgatgccatttacataacattcttgaaattctaaaattacagagatggggaacagatttgtggttaaagatggagccgggtgggaagaaagtaggtgtggctataaacgggtaacatgaaggatccttgtggtgatggaaatttctgtatttttattgtatccgtgtcagtatcctggttgtgatatggtaatacagttttgcaagatactacccttaggggaaatgaggtaagacctggcatctctctgtattatttcttaattgcatgtgaatctacaattatttcaaaataaaaagtatgattgaagtaactctcaggaagcttagcctactgtggattaagacatcaaaattgcagcaggctttaacaaagctatactactacaaggatagttcacacttgaattagcttgaaacattacctatccatgtcatcttggaaagcagaaaatggaactttattggagtgggacactggatggccagggtttagcagagcctgcccaacaaaagtagcttcagaattggctttattctcaggaaggctcttcctggacagtggcaaacatagccatagcaaatactggctcactttctatcagccagcaaccctggtggaaagagggcctcttactcagttgtaccagcaagctgtctccaggagccggggctggagagacacccagtgctgctctaggccagtgtggctgagggtctgtctagtctgtccttgtactcacggcttccttttctcttgcagacgcccactattgcttggttctacttcctttatcccgattggccgtcggacttatgccagtgcggcggagccggtgagtggaagcccagctacccgggagccagttggatggtcagaaccctttcttctgggcccctaggccctgagctaccctcagagtggggccttagtgtttccaggacactgggagccactttctcacttaaccctcccccaaagcccctcatcagtaatgagctcacacacccccatccatgtggggaggaagcagtaatgaggcactccagcccctcccagccaggaaggtatcactggaggcctaggtggggggcgagaactcccagccccacccagcaagttaggggttaagagtttagactccggaggcccagggcggtggctcccgcctgtaatcccagcactttgggaggccgaggtgggtggatcaactaaggtagggagttcaagaccagcctggccaacatggagaaaccccatctctactaaaaatacaaaattagccgggcgtggaggtgcatgcctgtaatcccagctacttgggaggctgaggcaggagaactgcttgaacctggaaggtgaaggttttgcggtgagccgagactggccattgccctccagcctgggcaacaagagccaaactccatctcaaaaaaaagaagaagagtttagactctggaatctctcagccctggtttcagttccagctctatcactagctacattgagcgttttaaaaagacctctgtttctcacatgtagcatgggggattgtagatgagatcctgaaggcagaagtaattttcccaagcaacattgctggttggtagccgagtctgggttagaacctggcctttccactataccatggtgcttctccagacaacaagaacaaggtagggagggccaggcttgggccactcaggaagcactaactctcactgcacagagggtggagaggcctggtcactttgcccctgtaccaccggttcctaacatggaatctgaccttgtaaaacaggttggcagcaaagctgtcctggtcacaggctgtgactctggatttgggttctcattggccaagcatctgcattcaaaaggcttccttgtgtttgctggctgcttgatgaaggtaagagacgagttatcttcttcaccattgtcttttacacatagtcattgttttttagtcttttaaaaagtgctttcctaacaactggctcacctttgcttaaaccagcctgtccattttccatcggcttcagtcccacttgttcttcatagctttgtccatccatcatccatgcatccatccatccatccatcctctcatctatccatcattcgtcaaatgctatgatgtacctgacactttgctaggtgcagtagaagaatgagaccttgtccctgccctgaagttgctccctgtcgagtggtgaggagacagccatgcatagacacagctgaagaattcgagtgaagcagattctcaggggtgtgcgagaatgttcggcgagactgtgtaggaggaagggattgatgatggcatgccagaggaagtgacatttgttctgggccatggcgagtaaataacactgccacaggtggagactgggaggagttacctgctggacgggaggaatagcctgggcagaggcttgaaagcatgaggctccttcgggacacattaagtagaatttaaggtgcatgaagggaagcactgggacccgagactgcaaaagcaaacagtgggcagtgccccagttagaaagttgtgcgcccaccaccacaatccactttagaatacgtccatcactcagaattctctctcttgaccattggcagttaatctccacatatacctctagccctgagcagccactgatttctatttctttaggtttgcattttctggacttttcatctacatgaaatcatacaatacatggccttttgtgccacacttcttgaacacttagtgtgatgtttttgagagtcatccatgttgcagaatgcatcagtagctcattcctttgtattgctgagtggtattctgttgtgtgcctatgctatatatatatacatatatgtatatatatatatacacatatatatatatatatattttttttttaatttatgtttttgagacagagtcttactttgtctcccaggctggagtgcagtgggtgcaatcttggctcactgcaacctctgcctcccgggttcaagtgattcccctgcctcagcctcccgagtagctgggactacaggcatgagccaccatgcccacctaatttttgtatttttattagagacggggtttcaccatgttggccagactggtctcaaactcctgtcctcaggtgatccactcaccttggcctcccaaagtgctgggattacaggcgtgagccaccacgtctggcccaaagcactatttttaaaagctacttgtattaatttttgttttttctttatcgctgtattatttatttgaaatataatgccatttatttgtgatctgttttccttgttgttgattcttgttgatgtaatttaatttctgaatatgtaaactgttaacaaggctgtaaaggcaaaaattatacaaattggtaaaatcaaagtagcgttattccctcacccctatctgttccactccattccttcatttttccccatgttacacaagtgtttgcatattgcatatactctttggttttttaaaacatcaacaatataccttggaaatcaggttgtatgacctcacagagatctttttcactttgttcacagctttgaagcacccactgagtgggcggatcataatttacttcatcaaaatctcctgtaaatgagcatttaggtgttttcaatattttgcaattacaaataatgccacaatgaataactttgtatttttgttattattggggggttatcttttttttttttcttttttttgagatggagttttgctcttgttgcccaggctggagtgcaatggcccagtgtcggctcactgcaacctccacctcccgggttcaagaaattctcctgcctcagcctcccaagtagccgggattataggtgcctaccaccacatctggctaatttttgtatttttagtagagagggggcttcaccatgttggtcagactggttatctttagagtaaattccttgggagtgagattgctcttagatcagagtgtaaataaaatatattgtcattttaaagatattcccaaattttccatcctaggggtcatgtaattttacattccctccaggagtgcatgagtgcctatttccacacaatttcaccaacagagtatgcatcaagcttttggtttttgccagtctgataggtgggaaatgtacctcagtgttgtttttattgtatttctcttctgagtgcatacccctgttctttaaggacatgacccagaagcttcctctgcagatatcacctgtgctctcattctcttggccagaacttagtcacatggccttacctggctgcaaggaaggctggaaaatgtagtgagtattctgagacaatatgtacccggcctaaaatgtcaggcgttctactgctatagaagaaggatgaagggaagagtgggcattcaggacaacttgctttctctgctcggtgggtgagacatttttctttattttcaagccagtaggaacccaggggaggaatttcccatactatgttgatatctttgtaatatttgatacccaacgtaaaatttcaataatataaacaagtaaaagaaatcatttatattgccatgctctaaacatcattccatctggatcagagaaggttttgtttgtccttttaatctttacttctttgaattgtgaaagtaatactacatattcataataaattcaaataatacagaagtatattatgtaaaaaagtgaagtcttcccaatctcttgctccaaggcagcttaaatgcaggtgtatacattatttgtgagttttgctattacaggtcgagtatctcttatctgaaatgcttgggaccagatgtgttttggattttggatttttccagattttggaatatttgcattatacttgctcagcatctctgatctgaaaatccaaaatccaaagtgctccaatgagtatttccctggagcatcatgtcagcactcaaaattcagattttggaacatttcagatttgggattattggattagggatgctcaaccggtattaacaaagcctgggtgagccatcttgcacatatatctttgcctccttccactggcgattcttaggaacatttcgtagatgtgaaagtgcaagttgcaaaggtgtgcaggttttaggttttgttcaaatccccaaactgctttcctgaaaggctgtcgctctcctgacagtgctcaagagaacccgtctggggagggttctggggaatgggtgtggcatccctggtgctggattcttctgcagaatgtggacctacctcagcgggtcccagcaagaaccatgatgccataaaaatgttgtaaagtcccttgtcctatgttaggcttctgtgccattgtgctggcttatccagtgacacagggagccacagtcagattccacagcacagggcagaggctgctcgatgctgcagaagactcttcaaaagggccttcggttctagtcctagactgaccactaaccccggaaggggacaaacatgtcccctccctgggcctcagtttcctcttacttaccctaataggattggactggtgatcttagatccttccactcctgcaacagtgattctagaattggttgactggtattttgaagaaagtaccagacaagctcattggcaggttatatctgttggtatctacctcttgacccattccatctgctatctgagatcagtcaggcaagtcagaaagcagttagcaccaccagaggctttggataaggcaccgtgggggttgaaagggggaatttgcttctagcccgattctgtagtgttagccccatgatggattccggctacatctgtacctaaacactctctctgctcttgttcagaattagtgttcctcttatctctcatatctcattgcctttggccaactcagggacttagctccagcagatgtctgccacctcctacgtcactggctccacgctctctcctgggtcatttcagcacatgcacacacacacacacacacacacacacactcactcactcactcatacagacctacaccaccacaccctgtgtacattacctccccacggctctgctccttgttgcagaaaagcacccccagagggggtgcaacccacctggatcaggctttgccccatcacgatgtttatttacttgtttatttattcagcagatatttactgagcacctaagataagctgacagtgttccctgttggagatacagcatataacacctcagtgagaagttcttgcccttgcggagcttatattccaaggggggatgataggcaaggaataagataagtaaattgcttctctgcagggtggtaaaagcagtagagaaaaataaaacaggaaaagaagataaagcatggtggacggggtgtcagattttcaagagggaggaaagatcacaccaagaaggtaaattggagctccctcatccaaaggaggtgcgggagggagtgtcacagaaaccaaggaggtgcgggagggagtgtcacagaaactaaggaggtgcaggagggagtgtcacagaaaccaaggaggtgcgggagggagtgtcacagaaatccaggggaagaggggacagtgcagtacagagctccaggagggagtgtgcagggtgcatctgagaaacagcatgaagcctctgtggctgaagcagaatgaggggggagtagagtgaagtgaggggcacgggagcagatcttgtatcagcatagggaaggcttaatgagaggtggcgtctcaccaccatctggaaagatgaacgggggctccctgcgaaatgggggcaggtggcatatgaggcactgccagtagtttgaggtcgccaaagcccagtgccctggtgggctgggaaaagaaggcaggaccagaccaggaaggtccatgagtgcctctgacccagcttttatcaaggatatcaacagcccccattttcccaaatccattggccacttctcagaccacatcatgctcaacccagcagcagcttttgaccaaataaaccacccttgctcgtaacacttcgtttcttgactctatgctctcagggttcttccccatcttgcttgctagctcctcctcctgcccatcctgtgaacatcacagtgcccaggctcgctcctctctgaagtgtttctaacacatgtgataagatgctgacgtataacatgtgtcgagtgtcctcatgttcttccctgaggtgctaaaccacctgaacatatatgctagagacaaaaacctttctgccagaatcagctcattggctgcctcagtattataagaaatggaaatagaagaggttgagcgactggaaagagttgttagtgtgctgatattttccctctgatggcaagtaaaatgaggtgggcttcatatgaatgccttggagagcttctggacttctccaagttcttgaactccccggagagcttcttggcttaccatgtgtgccctggagtctggaggccacagagtgtgatgctaatgtccaccagaagaagtctaaaggcccgagattgagacaggagtggctcgtctgggagcggagcacggagagctggtcgggagagggctatccttctacctgggcaggaaacagttgcctggccctgtgtggacagtggagagagctgcttggagtcaccttaagggtaaccatccagtgagctggctgggaggatccatgtggccccagccagaagcgggtacatcactgaggccaggggctgagggagcagatgcccggctgggggaggcacgctgccctgcgtctggagtggcagtcggaggtctccgtggcagaatctttgtagactccacagaagcaccccaagaaggaagagctggcttttgtgcacctgctctctcaggggcagcaacagcagacattagccagcctcagacgactacagtcttgcccctaatttgctgccccggatccaaccttggaagggtcagaagttaagaataggaggggagaggagctagaaaacagtgagaaagacaacctccaccagcacctacttcccacagccctcagggctgggcaggggaaagctttacctcgcatacaagtttgggagtttgggttctcaaaccaggctgggctggaattatttgcttaagagactgaacaggactcttcatgccaaaacaaagaggctctctgtccactgtctgagaatgagtggaaaagctatacaacttgcctgaagtttcatccagggctggaaaaaatagcttacaggtgaggttgaaagggacagtaagataaagaagtgggtttatcaataagccagttgcacacgcaccaacacagcggaactaaaagcttgtccctgagcagccagacagaggtggacagagactccagagacctgcagagggagcacggagaccagcagagggagcacacagacctgcagagggagcacggagacctgcagagggagcacagaaaccctgggtccagggaggtggtgtggcctgcggggcagtcttggcctgaggacaggtagaccctgagggggacaggccaccagagtctgcagccagcaggctgagggtggttggaaagatttctctgaataactgggggcaaattggtagtttctgtccctattggcgtggttgtcaggagcagggtgtggaggctgcccaaaggcaggtgagggttcctggggtgggtctgtcagtgaagataggagggtagcgttgctctcctcgggagcctgaagccgtgggcagtgagattaatcccctagtttcctctgaaagaagactcttcactgtcaaactgccaaattaagagtttactgacttggagtcgggggtttcccctgaggactgcagggaccttgtcgtgatgctgtgtaggggcaccagagaggtcttgtataggggtctgagaagagctgaatgatagcaacagggttaaccaagtcccaagaggaaggacatttagatacctcttgtgcatgtcagctagaatccacctttctgaggttcagatcatgtgagctccacgccaaggggcatttgaagggccaccaggtggaagactgcattaaagcaagacacgtgttttcctggtacctgtgtgccgcctgtggaagagaggggtctgcaggcaccacgtcatcacaccctagacctgaagatgcattagttctttcttggtggagtcctctgtgggaatgacagcctgagctccaggcccatctgtcccgtgcatctcatgcctgcgtcttgtttgggaaggtcggcgcacctaggggatttcagagccaaactttagaccatcgagcctccggcctggctgctgtgtccgaaggcatccctggtgcctctgcagagacttagcgggccacgccacagtgccttttcaaagggccactggggaggcttcctttccatggaaaaccaggcggtgaagacgacagtccaggaacggaagcggtgttaggtaggggagatcagcccgacctcctgtccaatgccgggattgtctctgtaccacctttcccacaccccatcctcaagcatccccccaacccccaaacatccctcctacctccaaacaaccccccaccccaactcattgcctcaacacctccaggcagctcatgccatctccagactgtgaagatcacgcctcattttgagctgagctggacttcttggtcctggctctgttctctgtggctgcatggaacaagctggctccctcagtcatgttccactcaagtcttctctccggggtgactacgtccagcacctccggccccattgggcagtcccttcaccatttcctcctgtgccctctgaaattgcatgatgtgatttctccattcccggggttggggttcttctggttgaaagcattcagaaggctcagcctaaccagcggaggactttccacccctgacaagtgctgaccgtcctgggctttccacccttgcccgcgcctgggatgtttgcttcagtagcagctgtgtgtgccatgggcaagcccttggctggcgagtgggcatttctctacccctttactcttggctgctagtcctgtcctcttacaagaggtgtcactatgccatgcaccattcaggaaaattgctgccaattaagtcatttatgaccaactatgtttaattttcacatcgagtgtagctcatccctattgtgaaagaaaccatgtttcatagaataggatgaaatgtgacaatgcagcctgcctggtgacacgagggtgcacgtgacaaagcacatcagcacttagcacagtgctcaggacagtggacactcgggaaatgctgtctacttagaggaaagccccccagcagctcggcagtgcccacaagcagacccctgccctcctctccagccctgcatccaccacctccttatgcgtctgcactgcctgcaaccaatggcttctggtggcgtcctcttatctcttcccacagtgccccgtccccatcggccccctcttgtgaatgtcctcagctgtcactgcctttggaaggtctcccctgcccgtccctcctgtgcccctcccacctcccgccaggttccatacagcacacagtcactgtgtcgcttacgtgctcacctgtctccttccctagaacacgactctgggaacaggggctgaatgattgatcttgacctccagttcctagcacagtgccggaacacgataggggcccaagaaatgtttgccgagcgagtgacgcctttctcctgtttagcagtacctgaatttgtgtggtgctttagactctttaacaggcttcttacaaatccatttccttactccattaatctgagcaggtcaggacaggtggtgatgttcctgttttacagccagaaaaaatggacccctgttcagggacacccctgagtgcacaaagcctactcagtgactgagctgggattagaggctggctctggcctcttaccaatttggagttgatgggcccttggcttagaacagaggtggcaaactggcagcctgctggtcctatgtggcctgtggacgtgctttggccttcacagtgtttttttgtttttttttttaaatgtgtgtaagttgccaacacttaaaagaatgaagagatttcccaattactagcttaaaaatgtaagcatctggcaaccctgggtttccatccccacgtggtaattcctgacatgtcctgtactccccagggcccccgcctgccccacataagtttgcaacccctgcttggagaaggaatcctgtcttgaggccttgggggccggctcttcatcctattcatggttgtgtctgtggcacatagcttgatgcttgataggtcatcagtgctcaggattaaaaagaaccgcatgctggtgggccaggcccatgggcagttgccagtatgcctgaggctttggctgggacttgaggccagctcctgccttgacaggagtcctcagggtctgcctcagggtgggaaggaaggaggtagaagcagctcttctctcctccccaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggtagggcgccccttcggacggcaggggttgtgtatggggccattccaaggggcacttgccgaacaccaccttccactggctggcatcctgccaccacactcccttccttattgtttaggctcttcctcctgcacagtaggaggaagaggattacactaaacatacacgtgcaatagggcaatggaaaaatacagtcaggaggtgatttcagagttcacggagtgctaggtggctacgcactgattcaggtcagttcagccaatgcccattgatgccccctctggcccaggagctgggttgggtgccagggacacaaagatggtcaaggcacattctgtccccaggacctcatagttcagccggaggactgagttcaaaatcagggagccgtgcattgagagaggcagagcagcacaggaaggaggggtcagtccagccatgggggcgcagtggaaataggccagttaaggcagattgtggcagagagcagatatggttgttccaagaggaggggagagcaggaaccacagcttcgaggagcacggggagggtagcgggggctgttggtcaagtggtgggattagccggcacctcaatatgagtcatgggtcaggtcacgcagagggggtggcagcaaaggaggttggggagggaggtcttggatcccaggcgagggaacatggctggtctcccaatggcactggggagccactgaaggggtcatcctgagggaatggcctggtcattgtgagacttgtgaatctccctctgaggatggcagtggcaatgtgaaggtggattcaaagcgggagttaaacatgggttctggactccggaactagggtggtaggtgttgggaaacaggaagggtcaggtgcgaggagtgttgagaaggcgaagctgcctggacttggtgacttggatgtggggatgaggtgaggcgcgaagtctctgtcctggacacctggtgccccgcactgcaggagcaggtggggagatagggagacactgaagcgcccaccctgagggaatgtccaggctagaagagcaggtgcccacggcaggtgacactgggagtcggggagatgcacagagggacccctgggaatgtgagtgttcggggatcagaggagggggagaggcagctgtcagagaggttggatacagttccccagaggctaaacaacagaaagtttggaggagagggcagtaccagtagccaacagggtcaaaagctacagaaagttccagtagcataaggactaaaatatccttccagttcagccagtggagggccttgtgggaggagctctgtctgcaacctcggggtgccattcatgtagaatacagcagtgggggatggagctccctggagccgggccgcccagcagcatctggagaagcgaatctatgaagtttacctttgagctccctgacagcccaggcagaaagggtgtgcgtcattcaggcctctgctttccctcagaatggggtggggcagctctcaggagcagctacttcagtggctggggaaggaggcggaaaaggcaggagtgaccagatcccatgcggggagctctgctgagcctgtatcagccagatggatgtgctgtctgtcacagcagctgcctcagaggctgcgtgtgtggctgtcggtgatgccgctcctctgcctgtctctgatgtgccacctcatcagcccactgtcgctcccatcctcccaacaggccattcacaggcctctctgttctctgttctcgctgaacatctgtttaataattaacaggcagagccagcccattaagaaaaggcaggatgggtcccgctggggtgattaccggctcagaacctgcagcctgcttcgcccttccctggcggtaaattctcctccctcccaccttccctgggcagctgctatattttccttcataaactactgggcaggaaaacagctgcatcggcaccataaagccacttgattatagcgtgggttttgtggtgatctaaaatgcccgtggaaaggcgtcatcaccggagacccaagcagagaacgcaccaggccggcttgctcaggctggcggtcctcgtcccctgcccccctgactctggggcagaatcacttccattgtctgtactggactggccaggcagcctaacctacaaggcagggtgggccccggcccacacagaggggaggcactcaccccctgcccggggatctgggctccaaccccagcaccagcctgacgcgcagacctttccctgctgcttttcccacgccgggcattccggagggctggatgaacctctcaccatcaacttccttaaccgatactgcattttttttttttggaaaaggatttgaagacttttaggtctgaagaaaacagtacatccgtcagatatgcagtggcgtgtcccccatctcctgctctcgctttcttcccgtctccctctcctccctctccctgcttcccctccacactctgccactctgccatgtcttggccttgccttggcaattccccctcaggcaatgccggctgtgaactccagggagcaccctcccagagcgttccgacccgcagtggccgccaccgacccacaccccatgcaggacatgtcagaagggtcctcttccccttctccaccgggggggcacatttggttggcgagtttgacgccctgcagcctggctctgtggaacagttgctgccaaagcccggggagccagccacgggggcgagatgaaggagattgtctggtgagagccacagagccatctgccaccggccccgacccccgcaggacgctgagggacaggacatctggagcctgggaccagccctccctgtccccaccccaggggacaccgagccagtgggcccgagagcaggccgtgggcatggcctgatcttggcacatcacttaccagtcagtcagtcaacattaattaattaattaattaatttttttgagacagagtcttactctgccgcccaggctggagtgcaatggtgcgatctcggctcactgaaacctccacatcccgggttcaagtgattctcctgtctcagcctcccgaggagctgggattacaggcgcctgccaccatgcccagctaattttttttttttttttagtaaagaaggggtttcacaaggttggccaggctggtctcaaactcctgacctcaggtgatccacctgccttggactcccaaagtgctgggattataggcctgagccaccacgcctgacctgggcttcacttattagaaatgtgatcttgggcttgcacctgccccctgtgtgggtctcagcttgcccatctgtgaagtgggagagtgctctgagccgtccagcactcatgcctggatcagaccactacaagagcatgggaagaatttcaacacaagctgctcgcaggctgacaggcagcagaacatatgtggaggagtaagggagaagcttggaaaaggcctggcctaccatgctgtgggatggagaccacagagcaggaagtgactgatggggggatccacctgaggaggggatggagaccatagagcaggaagtgactgatggggggtgcctgagcgggggatggagaccatagagcaggaagtgactgattggggggtcggcctgaggggggatggagaccatagagcaggaagtgactgagggggggatggagaccatagagcaggaagtgactgatggggcggggaggtcagcctgaggggggatggagaccatagagcaggaagtgactgatgaggggggtcggcctgaggaggggatggagaccatagagcaggaagtgactgatggggggggtcggcctgaggaggggatggagtccatagagcaggaagtgactgatgggggggggtcggcctgaggggggatggagtccatagagcaggaagtgactgatggggggggtcagcctgaggggggatggagaccatagagcaggaagtgactgatggggggggtcggcctgaggggggatggagaccatagagcaggaagtgactgattgggggggtcagcctgagggggagatggagaccatagagcaggaagtgactgatcgggggggtcggcctgagggggggatggagaccatagagcaggaagtgactgatcgggggggtcagcctgagggggagatggagaccatagagcaggaagtgactgatcggggaggtcggcctgagggggggatggagtccatagagcaggaagtgactgatggggggggtcggcctgaggggggatggagaccatagagcaggaagtgactgatgggggggggtcggcctgaggggagatggagaccatagagcaggaagtgactgattggggggggtcagcctgagggggagatggagaccatagagcaggaagtgactgattgggggggtcagcctgagggggagatggagaccatagagcaggaagtgactgatggggggcggtcggcctgaggggggatggagaccatagagcaggaagtgactgattggggggggtcagcctgatgaggagatggagaccatagagcaggaagtgactgatggggggggtcagcctgagggggagatggagaccatagagcaggaagtgactgattgggggggtcagcctgagggggagatggagaccatagagcaggaagtgactgattggggggggtcagcctgagggggagatggagaccatagagcaggaagtgactgatggggggggtcagcctgagggggagatggagaccatagagcaggaagtgactgattgggggggtcagcctgagggggagatggagaccatagagcaggaagtgactgatgggggggtcggcctgaagggggatggagaccatagagcaggaaatgactgatgagggggttggcctgaggggggatggagaccatagagcaggaagtgactgatgggggggtcggcctgaagggggatggagaccatagagcaggaagtgactgattgggggggtcggcctgaggggggatggagaccatagagcaggaagtgactgatgggggggtcggcctgaagggggatggagaccatagagcaggaagtgactgatgggggggtcggcctgaagggggattgagaccatagagcaggaaatgactgatgagggggtcggcctgaggggggatggagaccatagagcaggaaatgactgatggggtgggggggtcagcctgaggaggggatggagacatacagcaggaagtgactgatggggtcggcctgagggggggatggagaccatagagcaggaaatgactgatgcgggggtcggcctgagggggggatggagaccatagagcaggaaatgactgatgcgggggtcggcctgaggggggatggagaccatagagcaggaagtgactgatgggtctgcctgaggggtggggtgaagacggaggtggaggagtgagtgagacaaacagacccaggaggcttctccagcagcccaggagacaggcagcgaggacccaagggaatgctagtggaaacaggaaggaagaactgacccagcagaggaaaccagcaacagcctggggcgtggggactttgtcctcagagagatctgggtccaaatcccaccctccctgcctgttagctgggtgacattgaccaaggtgcttaacctctctgagcttcagttgcctcaaccggatatgagacaatttaggatctattttccagggtggttgtgaggatcagggaagttaatgaatgtaaagggcttgattaggggtctgccagctgtcatgttgatcttgagctgtaatattagcagtactgggtgactcagtaggtgggggaggggtggaggagctggaggagtcacagacaaaagtaaaatcattaacaaagaggaggagcaggcttgggcagcttggaaacttgacgtgttggttgtggttagggtgagtcagggacccgtgggacattcaggtggaagcgagacaggagatgggatgaggagagagagccgtgactcccaaggagaactgaggggccactggtgcggaggcgatcttggggatgttacaggaaagttgctgtcacccaaccagcgggcatgcctccgtgagtttattcagaacattggctgaggattccagatggcaactaggtccaccactctcaacactcattaaagctgtaatccaggggctgtgcactttcacaggtcatgtttcattaaacttttttggatagtagcgtcaaatgtcattgttttatttttaggtagagaaagggctgtatgcattttaagtcatgggatattgtccgttatgaatcaaacacaaaacggctgcaaaattcacaaacatgaagaagatgaggacacctaagagttaagtgtactttgagaggagcaggattaggccaggacattgggggccacttgtatctgggggcaggtgaaagaaaggtgtcagggaagatgcaggagatgcctgggtatcactaatgctgagggagaggtgagcctcaaggagtactggcagtactcatatcgtagcgagcctgaggagagtgaagactgggggtgaggtccttggtgtaccaccctggagaccctggagactgcgtggtcaggacagctgagggctgggacccagtgtggtatggaagggagatggagaggatagagcgcgcgcgcgcgcgtgtgtgtgtgtgtgtgtgtgtgcgtgctctgtcacccaggctggagtgccgtggcatgatccggctcattgcaacctctgcctcctgggttcaagagattttcctgcctcagcctcccgagtagctgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtgtcagccatgacgggtggggagtggcctgctgctcctcctgggaagagaagaaggtgaagactcagggcgcgtctgcagggagacagtgggagctgtggggtcgtggatgacgctgatcctgtcattagcatctgagcgaggtcacaggtgagacctagagcagggagacacccgcaaggctttggtggagagtgggagtgagctcttcatggacactctgttaaccagcaatttcctttccctaataaatgcccttaattctccataattgaaggagaaggcaccagagggcagtgaatgaagctttaatttgggtaacacggaaggaaagcagctagagaccaattactctgtcatttacacaaactcatttccatgattaacttggaaaataaagcagcgccgagttcccacaggcaggggagggccccaggatgggagctctgctctgaggctgtgccttgggaaggagcacggggctatcggcccgggagaccaaacactgagggtttccacaacaaagaggcagggcccagctctgtcctgaggctctgacccatccagcctttgcaccccaacaaactgaactcagagaggtccctgcaaaacacagctgcctcctcgtgcccacctcccctgtgatttccctggcttctggcaagagaagagaagacgtgagcaaaagctcaagggcagagatgagtaaacaggaacggggcgtgaaactcaaactcagggtgtggggatgggatggggtggagtggagtggaagtgggaatttgaggtgaggtgagactgaaggccgggggacacggcaggctgggtcatgatgggcccagagactcgagccaggcagatgtgacgtgaggactggacattctagacgcaagggagggctgcagtcagcactttaggcctctttacctcctgtcgttcctgagtgactctagaaagtttcttgagagcactgggcgagaggctgggaagtcacaggaaagaagcagagaggaggctggcctgcaggctgatgggcaatgtctgggccaagcccatgtggtaaatgcacatctatccctctcctgtccaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggtgagtgggaaagggagctccctcctgcccctgaacctgccccacgtgttcatctttgctcagaatggaaatacctgtcccagcagctccaatgtccacaactcagcagaggtgagctcgtgaatcccagggactatgctgggcctggggtgatggtgggcagaggggctgtggccgggtaggggaggaggaagcagagcaggtaagaggtcagtggtccatgcagcaaaagcttaaagagttgagcagccatccactctgcacacctaatctatagagagaatcaccctttgcacaaagctgtgtgtacacatctttgtatcagtcaggtgtggttagtaaaatctggcatattcattctatgggttatttatatcgtagtttaaaaaatgagatcattgtggtattagggaacaatagtaaaaatcaagattagaaatttggaaaaccaacaaaacacccaaaccatgtgggtggccaaatgtgagcaaaccactttagaagtcattgacttggatttttttctctggcatagcaaacaattgtggcaaaaagggtaagatccatacatctatggtgaagtcctagcaacaacaagcatgaacacagactgcagctgtaggattttagatggaaaccccaacccttcagtgacttcaaatttagagctttctgaaaggtgcctcccccaggatgggctgagttccctcccggggacacacctggatgggctgagtgccctcccggggacacacctggatgggctgagtgccctcccgggggcacacctggatgggctgagtgccctcccgggggcacacctggatgggctgagggccctcccgggggcacacctggatgggctgagtgccctcccgggggcacacctggatgggctgagtgccctcccggggacacacctggatgggctgagtgccctccccgggacacacctggatgggctgagttccctcccaggaaaactggtcccagatccgcctcggcttcccgggctgggccaaatgcaatccacttccaacccctctgttcccagggccaggaggagctgtgggaggcccctgatgcccccaggctgggcctgtggcctttggagggggatcaccacactctcccagtgcccaggactctctcctcatatcctagccctgaagtcaggttcagaaatcctgcccctgcccctgcctgctgctctgtttgccaggcggtcctggtctccacccaggctccaccctaccagggtggaatggagttggggagttgggcctaacagcacgggtcctgtcctctttcagggctgtcccggggctccctcccagctgcagccccaggtacttcctcgtctgcactccaacccccatcgccagggctgctgtcagtggctagacacttggccctagtgtgctacttatctgcacgtcgtactactggagctggactttaagctccataaggggaaggggaagctttcaggctgtatttctccctcaccagcaccagaccttgcctatagtgaaagctcagatccacacagacagctgtctcgcctcccacttctcccctcgtgttttcaccccaaattatcaccgcatcgggcttgatctggtttttgagtcagttgcgtgttgcccattacactgtgccctgctgcttctcactcacttgtcctcccctgtcctgcctggcacagccaggttcccagggaagaccaggggtgccgatgctgatgcgtgggcctgagctggccttgcctattgactgagaaggctcctgggtggctcagaagtggttccagccaagcctctagagacatgccagacttctgcccgctgtgtcatagggcagtaacggcttagcaggtacctctgtctccctctgtaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctt

SEQ ID NO: 37543 - DNA, 3641 bp, Homo sapiens; identical to SEQ ID NO: 35801

SEQ ID NO: 37544 - DNA, 75611 bp, Homo sapiens; identical to SEQ ID NO: 37416

SEQ ID NO: 37545 - DNA, 48668 bp, Homo sapiens; identical to SEQ ID NO: 36481

SEQ ID NO: 37546 - DNA, 2808 bp, Homo sapiens
agtctgggacgcgccgccgccatgatcatccctgtacgctgcttcacttgtggcaagatcgtcggcaacaagtgggaggcttacctggggctgctgcaggccgagtacaccgaggggtgaggcgcgggccggggctaggggctgagtccgccgtggggcgcgggccggggctgggggctgagtccgccctggggtgcgcgccggggcgggaggcgcagcgctgcctgaggccagcgccccatgagcagcttcaggcccggcttctccagccccgctctgtgatctgctttcgggagaaccttatcccctgaagtctggggaagagaacggagttgggcttcaaaccagtggtgtcctggggattctaggtggcctggcgggtcgcaggcgtcttgtcacccgcagtaaagcccttggcctccgccctattcccatctctgcccccaggcccaccccatgtcctgcaaacctcgctgcaggacgggcgggcgcggcggctgacatctgtaatcccagcagtttgggaggccgaggcgagaggcttgcttgagcccaggaggtcgagaccagcctggacaacctggggagaccctgatctccagaaatttattttattttatttttcttttttgagacggagtctcgctccgtcgcccaggttggagtgcagtggcgcgatctcggctcactgcaacccccgcctcctgggctccagcaattctcctgtctcagcctcccgagtagctgggactacaggcgtgtgccaccacgcccggctaatttttgtattttcagtagagatgggatttcgccatgttggccaggctggtctggaactcctgacctcaggtgatccacccgcctcgacctcccaaagtgctgaggttacaggcgtgagccaccgcgcctggctctatctttttaattcgccggacatggcggtgcacacctgtggtcccagctacttgggaggctgagacgagaaaatcgcttgagtctgggaggcaggtggaggttgcagtgagccaagatcacgccactgcactccagcctggaagagagagtgaaactccgtctcacgcacacacacacacagaaaaagaaatgcagggtagacttgctgaccaccctcatcaggctttgtaggggaggcgtctttctcctgtgcttgtcccttggtgctgctgtcaccacggtgcctgagtcttggtgcccccgctggagtctgaccctcgcccactgagtcttcgtcacatgtgaagccctgggcttgtgtgcgccagcctgccatcggcacttggtgcagcttgctggacaaacgaggaaagcgagtgggctgctagactgagtggctggcggcctgtccagaccctttccccggataggaacggcaggggcctcccatgtggcctcccctttcccaagcttctgtgtctctgcacattggagccatcggtgtgggagttttctggaggtcttgagggtgactggagctaggtcccagggaaatgaaagcttctaattggcttgggaagtgggagaggtggctccgtggagaagcagtctctctctgatggaaggaagcagaggtgaggaaagaccccacagcggcagagcagggcttgctctggctggggtgggggtgaaccagctaagggcaggcccctggagagctaccctgccgtggccagtgctggatgaggtggctgcacatcagcaccttggtggtcttggttttctaagctccccgcaattacttcgttttcatttcatttacatttcttacatacgttatacacacacacgtacagccagagtaggtgggagaggaggctcctcacgctccacccagggttctgggcatttccaggttactccagccaggatcatactgctagatctcagcttctgagccgggtgaatctgttcgccttgccggtggcggggggggtgaggccagcaggcagtgagaggcaggttggatgtgggctccaggcctttgcagaccgtagagaactcagttggcctctgctcctcccctcgacacagggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtgtgtgtatccgataccccactctggaaggaaccatccagtaaaggtctttcagaaccactaaggtcccagccctcactaggatgtcaggagccaggtctaggcccagctttcacactgtggcagcccagtgaagcagactgggccatgaactctcctagccctggggccagcctgttccacaggcacccctgcaggaggcgctgccaggagagccttccatctcggggctctttgaggttccctccttctgggtgttcttcaggctgagcagagaggctcctgtaccctctctctcggaatctgaagagccagatttaggccgggcaaaggggctcacccctataatcccaggactttgggaggccaaggcaggaggatcacttgagtccagaaattcaagacccgcctgggcatcataatgagaccccatctctacaacaaaatttaataaattagctgggcacagtgttcacacctgtagtcccggccactcggggctgaggcaggaggatcactggaacctgggaggttgccactgc

SEQ ID NO: 37547 - DNA, 116452 bp, Homo sapiens; identical to SEQ ID NO: 37245

SEQ ID NO: 37548 - DNA, 20871 bp, Homo sapiens; identical to SEQ ID NO: 35835

SEQ ID NO: 37549 - DNA, 8252 bp, Homo sapiens; identical to SEQ ID NO: 37182

SEQ ID NO: 37550 - DNA, 10962 bp, Homo sapiens; identical to SEQ ID NO: 35984

SEQ ID NO: 37551 - DNA, 11109 bp, Homo sapiens
gccacacggtctttgagctgagtcgaggtggaccctttgaacgcagtcgccctacagccgctgattccccccgcatcgcctcccgtggaagcccaggcccgcttcgcaggtacagactcaggcggcggcccggcccgagcgctaacggcttgcccgtgggcggcgttcgccttttgggttgggggagggaggccccgggtccacgccgagcctggctctgcctcccgcgttgactaggcctcgggggcgacgttcattgaccaggcggctgagtttcgcggggtctgcgggtttagggcgccgacgctctgcaaacggcagcggaggccttaacgcgtcgcggccgggagaatcggagcgagccaggcttgagggcgaatgtcccgggaggacttgtggcggccctggtttcgcctcctcctttctcgttgcatcttccccggcgtgggggcaggggctgggggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctgtaagttgacttggttcccctactttgtcttgaattaactattagggactctggagtatcgaactaggctgtcagaaacggtggatacatgtggctagtccaaattgaaatacgctgtaagcttaaagtacacaaaagatttcaaagatggagtatggaaaaagaatgtagaagatgtcagttattttatatattgataacacgttgaaatactatttggatatgttgggttaagtaaaatacattattaaaattagtttcacttgtttcttttctcctttttaaaaatatggctactaggaagtttcaatttatatagcttgcattctatttctgatggagagccctctccaggaagtctcagccctttagagggaagggggacacttcccctttgggtaaagctatttcatagtgccgaaaacatgatgatcccccctctagtatacaggtgtggattcagtagatgcttgataattcagttcttatttggtactattattgacaaaggaaaatgataaaggaaatatttttctcttcccccatcttttagctttctccctttgtctcataaccatgtccaccaacgagaatgctaatacaccagctgcccgtcttcacagattcaagaacaagggaaaagacagtacagtgagtaccttctgttgctttcctgtggtggtatttaaatgggaagacatttggaaaggggtgaaaactgaggtatttaaaaaaaaaatgccctcacttagcaacaaaaactggtgtgataggtgaaacggcatgttatcttttctcaaggaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccaggtaaaaaatgtattttagtttatgagttacgtgaaatccagaaaatcagtagggacttttcttagaaattcaagtaaacttaacatttctagtcttaacggttttaactatctgtgaacatctttttctctgtttgcaattagtaattgtcttctttcctgccttctgtaatccactgaagctgatttaggatcttcctttagctctgaccttccttcagacttccctgcatttctagctactagctgggtaccttggcctgaccagtgtgtccagagccagccagtttctggtttatttcttcttttttttttttttcccccgagatggagtcttgctctgttgctcaggctggagtgcagcagcacaatcagctcactgcaacctctgcctcatgggttcaagcaattctcctgccacagcctcctgagtagctgggattatgggtgcgcatcaccacgcttggctagtttttgtatttttttgtttttgtttctttgagacagagttttgctctgtcgcccaggctagcgtgcagtggtgcgatctccgctcactgcaagctccatctcccgggttcacgccattctcctgcctcagcctcctaagtagctgggactacaggcgcccgcaccctgtctggctaattttttgtatttttagtagagacggtgtttcaacatgttagccaggatggtctcgatctcctgacctcgtgatccacccgcctcagcctcccaaagtgctgggattacaggcgtgagccactgcccggcctgtttttgtatttttagtagaggcggggtttcaccatgttggccaggctagtcttgaactcatgacctcgtgatatgcctgccttggtctccagaagtgctgggattacaagcgtgagccaccaggcccttcccgtttttggtttatttctgccttttttggtattctctatgtttttgtatttgtcaccagctttgttcaggactttccttctgaaatatttacagtagcctcctaatttatcatatccttctttatgccatatactattttcctgaaatttttcctgaagtactgctttagacctgtgttttcgctccttaaaatccatactccaaattgcttgaacctgggaggtggaggttgcagtgagccaagatcatgccattgcactccagcctgtgcaacaagagtgaaactccgtctcaaggaaaaaaataaaaataaaataaatccatactccagctgggcatggtggttcatgcctgtaattccaacactttgggaagctgaaatgggaggatcactggaggccaggagtttgagcccagcctaggcaacataggaagacctcgtctctataaaaagtaaagttagctgggtgtggtggcgccggcctttagtcctaggtattcagggggctgagacagaagaatcacttgagcccgggattttgaggctgcagtgagctgtgattgcaccactgcaccccatgctgggtgacagtgagaccctgtctctaagaaatccctactctatgaaggccttccataaagtagacttaacttagattttcaaatttatctttcatctgggccctttcctacatgtttttctcacaatatgcttccttttttttttgttttgagacaaaaccttggtttgttgcccaggctggagtgcagtggtacgatcttggctgactgcagcctccgtctcctgggttcaagtgactctcctgcctcagcctcccaagtagctgggatcacaggggatcaccacgatgtctagctaatttttgcgtttttagtagacacggggattcaccgtgtttcccagtctggtctcgaactcctgacctcaggtgatccacccgcctcggcctcccaaagtgctgggattacaggcgcgagccacttcgcccagccaaacataaaccatttatatttgcagcaacacttaaccgtggaaatatgtagattataaaattagatatgaaaatcctcggccgggtgtggtggctcacacctgtaatcccattactttgggaggccgaggcaggtggatcacctgaggtcgggagtttgagaccagcctgaccaacatggagaaactccatctctactaaaaatacaaaattagctgggcatcgtggcgcatgcctgtaatcccagctactcaggaggctgtggcaggagaatcgcttgaacccgggaggtggaggcggtggtgagccgagatcacgccattgcactccagcctgggcaagaagagcaaaactctgtctccaaaaaaaaaagtcgggcatggtagctcatgcctgtaattccagcactttgggaggctgaggcaggtggatcacctgaggttggcagttcgagaccagcctgaccaacatggagaaaccccgtctctactaaaaatacaaaaaaaaaaaattagccaggcatggtggcgcatgcctataatctcaggtacttgggaggctgaggcaggagaattgcttgaacccaggaggcggaggtggtggtgagccaagatcatgccactgcactccagcctggggattgagtgaaactccgtctcaaaaaaaaaaagaaaagaaaatcctcagaacgttgcctatgacttcatgtctttctccctcaaagtatatctgaatgcaagtgattgagactaacgtagaaataatcttcagtctgctctgattcttgatttttgagacaaggtcttgtatggcgacaggcaaacaccaccatgcctggatattttttttttttttttttttttgttgggaggtctcactgtgttgctcaggctggtctcacctgagctcaagccatcctccctcctgagcctcccaaagtgctaggcttacaggtgtgagccaccatgcctgtccttctcgttcattttttaaaattgttcaaagctgccttttttagcgacaaaacacttggatactccataacttgagactccagtgagtccatgacaacaagtttggaaactgttctacatataaaataatgaatatttaacaggcaaaattaaatgtagggctaaatatttagtagctggctataagcctaacgatgtttacacttgccttcacaagtaagtgtggattttattgtttgtatttaatcttaatgataatgtgcaaactttcacttttcttctagggcactgtaaattggtctgttgatgacattgtcaaaggcataaatagcagcaatgtggaaaatcagctccaagctactcaagctgccaggtaagtcttgtctgcgatagcatgggtagcctaagaaatttgtgtttttagatttttttttgggggggtggggcaggaagggacagacagatagtacaaggaaagattaggccagccagccataagccaaatagtattttttatttattaatttttttgagaggggaggccttgctattttgcccaggctggcctggaatgcctgggttcaagcagtcctctgacctcagcctcctgaagtgctgggatcacaggtgtgtgccattgcacctgcccataaagtttttaccaaagtaatgtttcaagtcactggcaggggaaggaagaaataaatagtaagtgggattgagacatgcatttagaatgatatatccatttaggagataagtataatttgacctttacctcccactatacgtggatatttatgatataatagaaaggattaataagttctatagcttgacagtgtgcagaagaaaaatttcaatggtaaattatcattaaaaagttctaggctgggcgctgtggctcatgcctgtaatcccagcactttgggaggccaaggggtcggttacttgagcccaggagtttgagaccagcctgggcaacatggtgagagccagtttctacaaaagaaattattagctgggtgtggtggcacatgcctgtaatctcacgtgtttgggaggctcaggcacaataatcacttgaacccagcaggcggaggttgcagtgagctgagatcttgccactgcattccagcatggcgacagagcaagactctgtctcaaaaaataaataaataaaataacttgggtgtggcggtgcacacttgtcgtcccagctactaaggaggctgaggtgggaggatcacttgagcccaggaggtcaaggctgcagtgagctgtgatcgtggcactgcactctagcctgagtggagtgagatcctatttcaaaaaaacaaaatgtgcttaaccacaactatcagaacaaattcagtgagagtataaccctgtcagaatgtgaaaagtttttttaaaaagtgacaagatctggagtagatttctgcagggatggaaaggagggtaatctacattaatttctggaaaaatggtagttaattataccgcatacatagcaccatacaagtaatctgttcagcttctcttaggttccagaatgtctcagcatttagtgatttacttaaaaggttgtctgaagttctaaactcttgaattgcattttatattggtttttacacaaactccttttgttaatcactgtcaacttttatttgtctttttgttcccctttaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtacttggacttgaagttcttttgactgaatgtatctaatcgtaattagttggaagaaaggccttgttataagtaatagtgactttgtcaagttttgagcttgctttcaagcccttattaggaatgaaagtgtcgtctttacaaaggcagcagagggccatctaagtaagtttgggagtttttgctggtgcattcagtcactgaaaattgatggtgttggacaaggtaataaaattaatcttgcctcggccgggcatggtggctcacgcctgtaatcccagcactttgggaggcagaggcgggtggatcatgaggtcaggagattgagaccatcctggctaacacagtgaaaccccacctctactaaaaatacaaaaaattagccgggcgtggtggcgggcgcctgaggctgaggcaggagaatggcttgaacccaggaggcggagcttgcagtgagccgagatcgcgccactgcactccagcctgggcgacagagagaaactccgtctcaaaaaaaaaaaaaaaaaattaatcttgccttttttttcaggtgatggctcagtgttccgagacttggttattaagtacggtgcagttgacccactgttggctctccttgcagttcctgatatgtcatctttagcagtaagttactaacatgagtaaagttactcacttcttcattctaatttcccccatcttctcaaaagacagaacctctcattgcctattttttttcccccagtgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcaagaccagcctggccaacattgtgaaagcccatctctactaaaaatacaaggaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaaaagcataatcagttgatagtaatattgaaatattgcctatttcaggccatgatgggcctcttgttaaaacttttagggtatagaatttctaaagtgctggggaaaaaataaccagcatcaacatattttttttttttcagactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggtaacgaagtcttaggatttaatcaagtcatttttagtatttatagaaagctgtgcttgataagcttcttcacgtgcaagaatcttgggttctactaggagtcctttgctgaacaatacccagtaaccccttttacttaaggttggatagaaccttggtactttcagtcattgtttttgtgaaaaagtactcttggaatcttatttgtgcaactgttctgaaataaaaccatttccttatgtttaataggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggtaagtcctatcaaggtggctttgtttgaatttggacttgataataatcagtttactatttagacttgggggagggcagctgtaagtttactcactagtaagccacagaatcagaaagcctgtttatgtggccacccctttgattaaaaatgaggcaggcattataaaagatacaaaagagacgacaagtggatggtgtgacctgaatcggagtcaggcgcttatgtggactcatcacacctgtttacttggttgatttaatttcccaatttcataccgatttttggtgacattaaatttgaatgacttggccaggcacggtggctcatgcctgtaatcacagcactttggaagtccgaggtgggtggatcacctgaggtcaagagttcgagaccagcctggccaacatggcgaaaccctgtctctgctaaaaatgcaagaattagccatgtgtggtggtgggcgcctataatcccagctactcagaaggctgaggcaggagaatcgcttgaacccgggaagcggaagttgcagtgagccaagtttgtgttattgcactccagcttgggcaagagtgaaactgtcttaaaaaaaaaaaaaaaaaaagttgagccttcaataatggatgctagcgtatctgttactgtgtataaataatttgtcagtatgtggccagtatttcttcttcccctcatctaatcccctaagttattttgaagcaaatctgtttttttcatctatagatatttatgtatctctttaaggttgaaaatttaaaggaaaactaacctacataccattccatatgtccagtaaatccttaataccaacacacattctgtttggggacgtttagtttagcactccataggccatctttgcccttagacaccttgactacaccttgtgatgacataggatgctttacgaaacaatacacccctgttcccatagcagaccagttgaactggaatgtagtgttgttttaaaagttgcccgcatgattttgatacatagaaaaggttgggagctactactgattgtaagatctttggctccagttgaagtagtgctaaaagcaggtacagatccaatcacattgagtgtcaacaaaatataaaatggacataaaactatgataggcttgatgaaggaattgttaggtgcttatttctgcctgacgtatcaatattcaaattattgatgttttcttcattaaaataaaaccagagtatatgccagtaaacttggattttttttttttttaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggtgagtaatggatggtaatattaataacaacttggaaacataaagtcaaggccataagcctttttttcccttttaaaaataagtgtcatatctttgttaaatatagtaaaatatcagtgtgcatgggacataatgtacttatttgcccctctagtttggcttgatggtaataaaatctttttaaactgagattttaaaagtcaccagattagtttcaaatgaacaaccttgagaatcttagaatatcttgagggtaagttaacgggtgtcattgtaggaggtgatagagaagtaggccaaactcatcaccatgctctgggcctaatacagtcttttcctattgaaaagtgacggttggggaagaaaaaaatctcggcctgtttgtgttactgtagtagctagcatttatgaattggcaaagtttcagagaccctccctcctctatgtcaaatactataatatcatacaggattaaaggtgtaatatgcagatcaagacctagagattaaatacagacttcaggtaggctgctgcttggaatacttatatcatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccaccctt

SEQ ID NO: 37552 - DNA, 11111 bp, Homo sapiens
gccacacggtctttgagctgagtcgaggtggaccctttgaacgcagtcgccctacagccgctgattccccccgcatcgcctcccgtggaagcccaggcccgcttcgcaggtacagactcaggcggcggcccggcccgagcgctaacggcttgcccgtgggcggcgttcgccttttgggttgggggagggaggccccgggtccacgccgagcctggctctgcctcccgcgttgactaggcctcgggggcgacgttcattgaccaggcggctgagtttcgcggggtctgcgggtttagggcgccgacgctctgcaaacggcagcggaggccttaacgcgtcgcggccgggagaatcggagcgagccaggcttgagggcgaatgtcccgggaggacttgtggcggccctggtttcgcctcctcctttctcgttgcatcttccccggcgtgggggcaggggctgggggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctgtaagttgacttggttcccctactttgtcttgaattaactattagggactctggagtatcgaactaggctgtcagaaacggtggatacatgtggctagtccaaattgaaatacgctgtaagcttaaagtacacaaaagatttcaaagatggagtatggaaaaagaatgtagaagatgtcagttattttatatattgataacacgttgaaatactatttggatatgttgggttaagtaaaatacattattaaaattagtttcacttgtttcttttctcctttttaaaaatatggctactaggaagtttcaatttatatagcttgcattctatttctgatggagagccctctccaggaagtctcagccctttagagggaagggggacacttcccctttgggtaaagctatttcatagtgccgaaaacatgatgatcccccctctagtatacaggtgtggattcagtagatgcttgataattcagttcttatttggtactattattgacaaaggaaaatgataaaggaaatatttttctcttcccccatcttttagctttctccctttgtctcataaccatgtccaccaacgagaatgctaatacaccagctgcccgtcttcacagattcaagaacaagggaaaagacagtacagtgagtaccttctgttgctttcctgtggtggtatttaaatgggaagacatttggaaaggggtgaaaactgaggtatttaaaaaaaaaatgccctcacttagcaacaaaaactggtgtgataggtgaaacggcatgttatcttttctcaaggaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccaggtaaaaaatgtattttagtttatgagttacgtgaaatccagaaaatcagtagggacttttcttagaaattcaagtaaacttaacatttctagtcttaacggttttaactatctgtgaacatctttttctctgtttgcaattagtaattgtcttctttcctgccttctgtaatccactgaagctgatttaggatcttcctttagctctgaccttccttcagacttccctgcatttctagctactagctgggtaccttggcctgaccagtgtgtccagagccagccagtttctggtttatttcttcttttttttttttttcccccgagatggagtcttgctctgttgctcaggctggagtgcagcagcacaatcggctcactgcaacctctgcctcatgggttcaagcaattctcctgccacagcctcctgagtagctgggattatgggtgcgcatcaccacgcttggctagtttttgtatttttttgtttttgtttctttgagacagagttttgctctgtcgcccaggctagcgtgcagtggtgcgatctccgctcactgcaagctccatctcccgggttcacgccattctcctgcctcagcctcctaagtagctgggactacaggcgcccgcaccctgtctggctaattttttgtatttttagtagagacggtgtttcaacatgttagccaggatggtctcgatctcctgacctcgtgatccacccgcctcagcctcccaaagtgctgggattacaggcgtgagccactgcccggcctgtttttgtatttttagtagaggcggggtttcaccatgttggccaggctagtcttgaactcatgacctcgtgatatgcctgccttggtctccagaagtgctgggattacaagcgtgagccaccaggcccttcccgtttttggtttatttctgccttttttggtattctctatgtttttgtatttgtcaccagctttgttcaggactttccttctgaaatatttacagtagcctcctaatttatcatatccttctttatgccatatactattttcctgaaatttttcctgaagtactgctttagacctgtgttttcgctccttaaaatccatactccaaattgcttgaacctgggaggtggaggttgcagtgagccaagatcatgccattgcactccagcctgtgcaacaagagtgaaactccgtctcaaggaaaaaaataaaaataaaataaatccatactccagctgggcatggtggttcatgcctgtaattccaacactttgggaagctgaaatgggaggatcactggaggccaggagtttgagcccagcctaggcaacataggaagacctcgtctctataaaaagtaaagttagctgggtgtggtggcgccggcctttagtcctaggtattcagggggctgagacagaagaatcacttgagcccgggattttgaggctgcagtgagctgtgattgcaccactgcaccccatgctgggtgacagtgagaccctgtctctaagaaatccctactctatgaaggccttccataaagtagacttaacttagattttcaaatttatctttcatctgggccctttcctacatgtttttctcacaatatgcttccttttttttttgttttgagacaaaaccttggtttgttgcccaggctggagtgcagtggtacgatcttggctgactgcagcctccgtctcctgggttcaagtgactctcctgcctcagcctcccaagtagctgggatcacaggggatcaccacgatgtctagctaatttttgcatttttagtagacacggggattcaccgtgtttcccagtctggtctcgaactcctgacctcaggtgatccacccgcctcggcctcccaaagtgctgggattacaggcgcgagccacttcgcccagccaaacataaaccatttatatttgcagcaacacttaaccgtggaaatatgtagattataaaattagatatgaaaatcctcggccgggtgtggtggctcacacctgtaatcccattactttgggaggccgaggcaggtggatcacctgaggtcgggagtttgagaccagcctgaccaacatggagaaactccatctctactaaaaatacaaaattagctgggcatcgtggcgcatgcctgtaatcccagctactcaggaggctgtggcaggagaatcgcttgaacccgggaggtggaggcggtggtgagccgagatcacgccattgcactccagcctgggcaagaagagcaaaactctgtctccaaaaaaaaaagtcgggcatggtagctcatgcctgtaattccagcactttgggaggctgaggcaggtggatcacctgaggttggcagttcgagaccagcctgaccaacatggagaaaccccgtctctactaaaaatacaaaaaaaaaaaattagccaggcatggtggcgcatgcctataatctcaggtacttgggaggctgaggcaggagaatcgcttgaacccaggaggcggaggtggtggtgagccaagatcatgccactgcactccagcctggggattgagtgaaactccgtctcaaaaaaaaaaagaaaagaaaatcctcagaacgttgcctatgacttcatgtctttctccctcaaagtatatctgaatgcaagtgattgagactaacgtagaaataatcttcagtctgctctgattcttgatttttgagacaaggtcttgtatggcgacaggcaaacaccaccatgcctggatattttttttttttttttttttttgttgggaggtctcactgtgttgctcaggctggtctcacctgagctcaagccatcctccctcctgagcctcccaaagtgctaggcttacaggtgtgagccaccatgcctgtccttctcgttcattttttaaaattgttcaaagctgccttttttagcgacaaaacacttggatactccataacttgagactccagtgagtccatgacaacaagtttggaaactgttctacatataaaataatgaatatttaacaggcaaaattaaatgtagggctaaatatttagtagctggctataagcctaacgatgtttacacttgccttcacaagtaagtgtggattttattgtttgtatttaatcttaatgataatgtgcaaactttcacttttcttctagggcactgtaaattggtctgttgatgacattgtcaaaggcataaatagcagcaatgtggaaaatcagctccaagctactcaagctgccaggtaagtcttgtctgcgatagcatgggtagcctaagaaatttgtgtttttagatttttttttggggggtggggcaggaagggacagacagatagtacaaggaaagattaggccagccagccataagccaaatagtattttttatttattaatttttttgagaggggaggccttgctattttgcccaggctggcctggaatgcctgggttcaagcagtcctctgacctcagcctcctgaagtgctgggatcacaggtgtgtgccattgcacctgcccataaagtttttaccaaagtaatgtttcaagtcactggcaggggaaggaagaaataaatagtaagtgggattgagacatgcatttagaatgatagatccatttaggagataagtataatttgacctttacctcccactatacgtggatatttatgatataatagaaaggattaataagttctatagcttgacagtgtgcagaagaaaaatttcaatggtaaattatcattaaaaagttctaggctgggtgctgtggctcattcctgtaatcccagcactttgggaggccaaggggtcggttacttgagcccaggagtttgagaccagcctgggcaacatggtgagagccagtttctacaaaagaaattattagctgggtgtggtggcacatgcctgtaatctcacgtgtttgggaggctcaggcacaataatcacttgaacccagcaggcggaggttgcagtgagctgagatcttgccactgcattccagcatggcgacagagcaagactctgtctcaaaaaataaataaataaaataacttgggtgtggcggtgcacacttgtcgtcccagctactaaggaggctgaggtgggaggatcacttgagcccaggaggtcgaggctgcagtgagctgtgatcgtggcactgcactctagcctgagtggagtgagatcctatttcaaaaaaacaaaatgtgcttaaccacaactatcagaacaaattcagtgagagtataaccctgtcagaatgtgaaaagtttttttaaaaagtgacaagatctggagtagatttctgcagggatggaaaggagggtaatctacattaatttctggaaaaatggtagttaattataccgcatacatagcaccatacaagtaatctgttcagcttctcttaggttccagaatgtctcagcatttagtgatttacttaaaaggttgtctgaagttctaaactcttgaattgcattttatattggtttttacacaaactccttttgttaatcactgtcaacttttatttctctttttgttcccctttaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtacttggacttgaagttcttttgactgaatgtatctaatcgtaattagttggaagaaaggccttgttataagtaatagtgactttgtcaagttttgagcttgctttcaagcccttattaggaatgaaagtgtcgtctttacaaaggcagcagagggccatctaagtaagtttgggagtttttgctggtgcattcagtcactgaaaattgatggtgttggacaaggtaataaaattaatcttgcctcggccgggcatggtggctcacgcctgtaatcccagcactttgggaggcagaggcgggtggatcatgaggtcaggagattgagaccatcctggctaacacagtgaaaccccacctctactaaaaatacaaaaaattagccgggcgtggcggcgggcgcctgaggctgaggcaggagaatggcttgaacccaggaggcggagcttgcagtgagccgagatcgcgccactgcactccagcctgggcgacagagagaaactccgtctcaaaaaaaaaaaaaaaaaaattaatcttgccttttttttcaggtgatggctcagtgttccgagacttggttattaagtacggtgcagttgacccactgttggctctccttgcagttcctgatatgtcatctttagcagtaagttactaacatgagtaaagttactcacttcttcattctaatttcccccatcttctcaaaagacagaacctctcattgcctattttttttcccccagtgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcgagaccagcctggccaacattgtgaaagcccatctctactaaaaatacaaagaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaaaaaagcataatcagttgatagtaatattgaaatattgcctatttcaggccatgatgggcctcttgttaaaacttttagggtatagaatttctaaagtgctggggaaaaaataaccagcatcaacatattttttttttttcagactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggtaacgaagtcttaggatttaatcaagtcatttttagtatttatagaaagctgtgcttgataagcttcttcacgtgcaagaatcttgggttctactaggagtcctttgctgaacaatacccagtaaccccttttacttaaggttggatagaaccttggtactttcagtcattgtttttgtgaaaaagtactcttggaatcttatttgtgcaactgttctgaaataaaaccatttccttatgtttaataggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggtaagtcctatcaaggtggctttgtttgaatttggacttgataataatcagtttactatttagacttgggggagggcagctgtaagtttactcactagtaagccacagaatcagaaagcctgtttatgtggccacccctttgattaaaaatgaggcaggcattataaaagatacaaaagagacgacaagtggatggtgtgacctgaatcggagtcaggcgcttatgtggactcatcacacctgtttacttggttgatttaatttcccaatttcataccgatttttggtgacattaaatttgaatgacttggccaggcacggtggctcatgcctgtaatcacagcactttggaagtccgaggtgggtggatcacctgaggtcaagagttcgagaccagcctggccaacatggcgaaaccctgtctctgctaaaaatgcaagaattagccatgtgtggtggtgggcgcctataatcccagctactcagaaggctgaggcaggagaatcgcttgaacccgggaagcggaagttgcagtgagccaagtttgtgttattgcactccagcttgggcaagagtgaaactgtcttaaaaaaaaaaaaaaaaaaagttgagccttcaataatggatgctagcgtatctgttactgtgtataaataatttgtcagtatgtggccagtatttcttcttcccctcatctaatcccctaagttattttgaagcaaatctgtttttttcatctatagatatttatgtatctctttaaggttgaaaatttaaaggaaaactaacctacataccattccatatgtccagtaaatccttaataccaacacacattctgtttggggacgtttagtttagcactccataggccatctttgcccttagacaccttgactacaccttgtgatgacataggatgctttatgaaacaatacacccctgttcccatagcagaccagttgaactggaatgtagtgttgttttaaaagttgcccgcatgattttgatacatagaaaaggttgggagctactactgattgtaagatctttggctccagttgaagtagtgctaaaagcaggtacagatccaatcacattgagtgtcaacaaaatataaaatggacataaaactatgataggcttgatgaaggaattgttaggtgcttatttctgcctgacgtatcaatattcaaattattgatgttttcttcattaaaataaaaccagagtatatgccagtaaacttggattttttttttttttaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggtgagtaatggatggtaatattaataacaacttggaaacataaagtcaaggccataagcctttttttcccttttaaaaataagtgtcatatctttgttaaatatagtaaaatatcagtgtgcatgggacataatgtacttatttgcccctctagtttggcttgatggtaataaaatctttttaaactgagattttaaaagccaccagattagtttcaaatgaacaaccttgagaatcttagaatatcttgagggtaagttaacgggtgtcattgtaggaggtgatagagaagtaggccaaactcatcaccatgctctgggcctaatacagtcttttcctattgaaaagtgacggttggggaagaaaaaaatctcggcctgtttgtgttactgtagtagctagcatttatgaattggcaaagtttcagagaccctccctcctctatgtcaaatactataatatcatacaggattaaaggtgtaatatgcagatcaagacctagagattaaatacagacttcaggtaggctgctgcttggaatacttatatcatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccaccctt

SEQ ID NO: 37553 - DNA, 6464 bp, Homo sapiens; identical to SEQ ID NO: 35826

SEQ ID NO: 37554 - DNA, 25862 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggtgagttcggggtcccgagtcctcgccggacctgcggtttgcggggaaaggcctcgagaccagagctgcacgggccttggctccagaggctctcgggatgtcagcaggccctgggctacagagggtctccggggccccagacgcaaatccgcgataccctcaggtccagcttaggcggctcgccctccgggttcctcggggaacggaagaggctaggccgccattgtttacaattcggatggctccgccctgcgaggcttcctgactaggttcctctggagctggagagggaccaaggaatgacagctcccagcgaggggctccggttcctcccgaagcacctcttaaggtgccatcatttagttctaggtggctcaagtaatatttttatcccctagcacgggatttgccaaaactacagagtgtgtggcaaagctggggttttagcggaggcttgtctgcagttcaggtgcaagggaaagaagcccttgtggattgttattcaaaattggaaaccagggcctgaatattttgggactgctgtaagtcatttatccgaggataatcaccccagcattcctctcttcgagaacgattgtgacagtgaagtgaaggtttaatcaccttgtaaactgtaaacattttaaagagaaaattatagggcctataaaagaatatgctgagttccctcatttacccacttcagaggagcgtgattccttgattcctcattctccagctgatttaattgaccaagtgtgtagaaaaagcacactcagtttctcctgctgtactcacaacacacttttgacacctgatgtgtggtgtgtggggattttcccccaaacatcaggcaaacagtcagctctgcaggggatgccaacttggtgccctacaagtcaattccgaagctctctacttggagatagcatcaaatcacacaagtggagggctcagtctcacaagactgtgcccactttctgtgccaatggcaagcctcaggttgttttacctgtgcttctgaccggccacctataaatcaaagttcccgtgacctccctccttggctttgattaatttggtcacaaaactcaaggaaacatgtttactggtttattataaaagtattttattttgtgtatttatgtatttttaattttagattcagagggtacatatgcagttttgttacatgggtatattgccttatcgtgaggtttgggtttctaatgattccgttgcccaaacagtgaacacagtatccaacaggtagtttttcaacccctatccccccaccgtccttccccactcttggactctccagtgtttattgttgccatcttcgtgtctgtgttcccagtgtttagctcccacttgtaagcgagaatatgctgtatttggttttctgtttctgtattaattcacttgggatagtggcctccagctgcatctttgttgctgcaaaggacatgattttcttctttttttatggctactattaatatatttttaaagatacagatgaagtgatatgtaagacaaggtgtagagggaacgggtctggagcttccatgctctgtctggggcagtggcgccatctcggctctcttcaacctccaagggattctcatgtttcagcctcccggagtagctgggattatagtgtatgccaccacgcccagctaatttttgtattttcaataaagacgggatttcgccatgttggccaggctggtctcgaactcctggggtgtgagccaccatgcccagccaaaagttcttctgaactttgtccttctgagcttttatgcaggcttcattatgtagtcagcattcattaaatcattggcttttggttactgacctaaccttcagcccctccttggagggtcaggggtgagactgaaaagtcccaacctcctactatgaccctcacccatcatgaagccacctaggggctgccagtcaccagtcatctcattagcatacaaaaagacgctggttattccaaggattttagaaattgtatgccaggaaatgggaaccaaacatacatatatttgacagtattacaccaaggattctgtttcagctctttctactatttttcttttttttttttggagggggacagagttttgctctgtcacccaggctggagtgcagtggctcagtcatagctcactgcagccttgaactcctggattcaagtgatcctcccacctcagccttcccagtacaggtgtgtgacaccatgcctggcttcattccactatttcttaggaacagaatgtattttaaggttgttggtcctaaatcaaaagagtgttccatttttaagggctttcttgagagcagtggttttctaattattctgaccttgacctaaagaaagattgtacatagttgatctgtgatctgatgcacccatatagagacaaagttttatgaaataatcgtttactgtacaatttttcttttatcttctatcacattagaaaatcctggtgagttgaaggccaggcatggtggctcacgccaggatggtctcaatctcctgacctcgtgatccgccggcctcccagagtgcttggattacaggtgtgagccaccgcgtcttgcccggcttttactcttaagttatatgggaatctattacagagtttgaaaaaaggagtgatgtgatctgggcctgtgttttaacgaggtggtttctggttgctgtgtggagaatagatggtagaaaagtaaaggtaaagcagtgtaggctgggaagaatcttcctccagccttttgggttctgtttctgggggcttgtgaattaaactgacaaaacagattatttagagtttatgcatgcaagacatgtacacacaggagtgctcagtaatagtaactcaaagggggcggttagaacttgaggctttttttttttttttcgtttttgagaaaacaagttccactcttgttgcccaggctggagtgcaatggtgggatcttggctcactgcaatctccacctcccaggttcaagcgattctcctgcctcagcctcccaagtagctgggattacaggcatgtgccaccacgcctggctaattttgtatttttagtagagatggggtttctccatgttggtcaggccggtcttgaactcccgacctcaggtgatctgcccacctcagcttcccaaagtgctgggattacaggtgtgagccactgcacccagccaaggctttctaatttagtaggaaaaaggaagctgggagaaaggcttctatgagaagaacaaataggtttctttaggaaagacaagtttttttaggagaataaataggaaatacgtttgtggtagtacttgtttatgcaggtatggtgggtctttccagcttcttcatgatcttaaaactgccctggagagggactttatggcagcctcgtttcccagaagttgctgcttttagtcagataagagaagctcccagaaggcttttttttttcctctgcatctgttgaagctcagatgcttcagcttaaaagcttaaaataatctttataacaattcagggcttcttttttttttttttttttttttgaggctaattttgcatttttagtagagacaggatttcactgtgttggcctggcgggtcttgaactcctgacctcaggtgatctgcctgccttggcttcccaaagtgctgggattacaggcgtgagccactgtgccggccaactcagagcttctgaatgggtcgctacagctgtgagatgggaacttttgcgcttaatccagatgagagatgatagttgtggcttggacaaaggtgatagctaaggatactgtgaaaatggtcagattctggatatattttaagggtagagctgatgtactgacagattggatgaggattttgggaaaagggaaggcattcgggatgactccaggttttgggcccaagcaacaggaagaatggagttgtcatttactgaaatagaaaaatgacataacatatagtaggacagatttgtcccacagatatttactgagtacctgctctgtaaagatacaaaagatataacgttgtaaagatagtctccccttcgagatatttacattcttaagacaactataggtaagtaagtttattagtttgccagggctttataacaaagtaccacagaccgagtggcttaaacccagtgatttcttatctctgaattctagaggctggaagtctgggatgaaggtgtcagcagggttggttccttctaagggtggtgagagagaatctgtatcatgcctctcccctggctttttttttttttggtttgctggcagtctttgatgttccttggcttgtagatctctgccttcacatggcatgtggaattctccctgtgttgtaagcctttgtccaagtttcccctttttataaggacacagttatattgaattagctgctcactctactccatataacctcatcttaacttactacatctgcagtgaccaagtaaggatacattttgaggaattgggcattaggacttcaacataagaatttgtggaggacatgcctctgcagtgtttggcctatactgtagttaagaattggagactgagactggctggtcaatttcccattgctattgcaattacaaataataatggctaccacgatatattgagcctgataaatatgtcaggcattatactaggttctttatattcctgacatcatctcattctttgctcaatcaccctgttcgagtaggtggtattatgctcatttttacagatgagaaaactgaacttttttagaatgttagcaccctgctgcaaaccacacaaaattatcataaagtgcacacaagataccatctataaaaaaatgaagattattcctgggaccatattttaagaccagagttatccattgtttacttctgctaattctgaattagcttgtccttgtaatatgacttgataatgtcaccccctcagagcaatttcaagcagtttcctaatcaagcataatgactcaaattatatcctctcttagctgggcatggtggtgcttgcttgtactcaggaggctgaggccagaggatcgcttgagcccaggagtttgatgctgcagtgagctgtgatcacacaactgtactccagcttgggcaacagagtgacgccttgtctttttaaaacaaaacaaaacaaaggccgggtgcattggctcatgcatgtaatcccagccctttgggaggcggaggcgggcagatcacttgaggtcaggaattcgagaccagcctggccaacatggtgaaaccctgtctttacacaaaaattagctgagcatggtggcacgtgtctgtaatccctgtaatcccagctacttgggaggctgaggtagaattgcttgatcccaggagggtgaggttgcagtgagccgagatggcgttactgcactccagcctgggagacagagtgagaacctgtctcaaaaaaaaagaaagaaaagaaaaaaagaaataaaattatatcttctttcatgtagtgtggtcactaacagattttagcagactaaagatctaggttactctttttttttgagacggagtctcagtctgtcgcccaggctggagtgcagtggcacaatcttggctcactgcaaccttggccacccgggttcaagcagttctcctgcctcagcctcctgagtagctgggattacaggtgcctgccactgcacccggctaatttttgtatttttagtagagatggggtttcaccatcttggccaggctggtcttgaactcctgaccttgtggtccacctgccttggcctcccaaagtgctgggattacaggcgtgagccaccacgcctggccctaggttactctttaaaaaaaaggaggtaaagttgacataaaattaaccatttcaaaatgtttagtgggccgggtgcagtatctcacgcctgtaatccagcactttcggtggccagtgtgggtggattgcctgagctcaggaattcaagaccagcctgggcaacatgacaaaaccctgtctctactaaaaaatacaaaaaaaaatcagctgggggtggcattgcacacctgtagtcccagctacttgggaggctaaagcacaagaattgcttgaactcaggaggtggaggttgccgtgagccgagattgtgccactgcactccagcctgggcaacagagtgagactgtctcaaaaaaaaaaaaataaaaaagcgtatagtggcatttagtacattcacaatgttttgctgccatcacatctgtctagttcgtcgccctaaagggaaatcctttacccattaaaccatcactcccatttcccttcccttcaacccctaatcttctgtctctagattcacttattctggatattttattatataaatgcactaatacagtatgtgacctttcatgtctggctttttaaataactttgcatgatgttttcagggttcacctgtgttctatcatgtatctatctattatgtctgaataagccattgtatagatagaccaagtctcactctgttgcccaggctggagtgcagtggcatgatttcagctcaatgcaacctccacctcctgggttcaagcaattctcctgcctcagcctcctgagtagttggggccacaggcatgagccaccacgcccggataatttttgtatttttagtagagatgggatttcatcatgttggccaggctggtcttgaactcctgacctcaggtgacctgcccacctcagcctcccaaagtgctgggattacaggtgtgagctgccgcacccagccagatataccatatttttacttaggccatatttacttatcaattaatggacagtgggttgtttccacattttggtgattgtaaatagtggtgctgtgaatattcgtgtacaagcttttgttttaatagcagtttcaaacaaaacagctattggggtcgggtatatactttctgggtcatatggtcattctgtatttaactttctgaggaacctggttcctcttgaattgagctaaatggcccttgctgttattatttgtcagagggtttccatgtagtgttgctttatttttttattttattttatttttttgagatggagtctcgctctgtagcccaggctggagtgcagtggcgcaatctcagctcagtgtgagctccgcctcctgggttcatgccattctcctgcctcagcctcctgagtagctgggactacaggcgtccgccaccacacccggctaattttttctgtatttttagtagagacagggtttcaccgtgttagccaggatggtctcgatctcctgaccttgtgatccacccgcctcggcctcccaaagtgctgggattacaggcgtgagccaccacgcccggcatgttgctttatgttgtaatatcagctttggtaacttggattcgcagtaagcagcaagtggagttaggtttatatttttctcatattttaaaacaaatgatgctctcagaatataattaacatttattgaactgttaatgcattttaggtagtgttgagtgctcatttaatacagcagagtctgagggaggaaaattccattattgagctcattttacaaatggtcaaatggggttagagtacgtaacttgctggggtaaaaagcggcagaaataatatttactccagagcccgtacttttaaccacttcctcccagccatgattctctgagttaaaactataaagcctgatttgcctcgctttctcttctgcgacatctgtgtcataaaggagtatactgaaggcggtctcaggtgaccatggtgtgctcattccaggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaaggtaagaagtaacagtgcccttaaggtattggttatttttatttttatattctgcaaaattctagttttatttcgtcgttgttaatcaagttggttgtaatttggagattttttacttatatgggggtgtggtcaaaacacagaaatatgaggacattagtccttttccagaaatacagaatgaacatctgggctccagtcgaacaactgagagaaaacattaaaagggtggctccaaaacattttctttccttatgtgttaaaggtcgaagcatctaaactggactagttcttcacctttggaaggactcagtcgtagctggaaaatctcacaggaaagtggcacacagcctcttcatcctaaaagggcaaagaagagagaccatatttttttgaaactaagactcactctgttgcccaggctggagtgcagtgacatgatcttggctcactgcaacctccgcctccctggttcaagcaattctcctgcctcagcctcccgagtagctgggattataagcatgcaccaccatgcccgggtaattttttgtatttttagtagagatagggttttcaccatgctggccagggtggtctcgaactcctgacctcgtgatccacccacctcggtcccccaaaatactgggattacagatgtgagccaccgtgcccagccgagagagcatttttatttttaaaatgcatgttatttatactgtttggtaacaagattgtaaatgaattggaagacaaagagaaaaattccatagtcagtcttgcagttgttgaagtagttaattttctaaatccaggctttcctgcagtgggttagagtctctgtctaaatgtagatattctcgtaacattgaaattgcttttttccagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggtatgttagatttatgattaactggttacattatggtgtggctcttccttcccttcagcagttaatatagccattctgatgaaatcaatggaatatgtaaatgagtggctcagatgcatttctgatctattatgcatgtgaaattgttttaatgtcattttcagttagattgctgtaacatggaggggatagggggtcttgtctttttattttcttctattaaattcctttgcttcatgttcttagatttttattgaacacctgttaaatagttgaagcactatgctagatactacgtacacacacacttttttctttctgttgtttaaagataaacatgtacctgataaatttaaacagtgtacaaaagtcagtgaatatatatgtgctactgatttacatattctattgcttctgactcctgaccaccttttacctatgtttctaattctctcctttttttttttttttttttgttttgtttttggagatggagtttcactcttgtcacccaggctggagtgtaatggcgtgatctcggctcactgcaacctccccctcccgggttcaagtgattctcctgcctcagcctccctagtagctggcattataggcacctgccaccatgcctggctaatttttgtatttttagtagagatggggtttcaccgtgttggccaggctggtctagaactcgtgacctcaggtggtccgcccgcctttgcctcctgaagtgctgggcttacaggcgtgagccactgtgcccagccgtatttctaattctcaaagactgaatggcgttttataaacttgatgtgtattataatcccctttttacagatgtagtaactgaactgcagagaggttaataaattgtctgagacctgttaaccagttggaggttggagctaagattgaaacttagatctgtccagctccaaagcctggttctttccactctgccatacaaggcagtcattaaagatcatgaactgaaaatcaggtgccagtgatgagctgtgtcattgtgggcaaggtatctgtgccctgtgttgtaaatatttgtgattacttttcatccagaccttaacagttaatggctgtgtgtgtacctaacactgttattttagaactcccagaatgctagaaaaatgcctacctttaagtgctaaaagtagggagactctaaattttcagttttctctggtaataaatgtgagtgatttatcttctaggctaatgttgtcctttaattgtgtgaaatattaaatgaattagcctattaaatgaatagtcaaatgaagaaaatagtccagacaatcatgttgggaaaaaagctattaagttattatttttgcatttcagaaatgaatttttctcagtataagggtgaaacttagcatttcataaatgcatttttatattttaataggttttggttcttcaaaattgctgcccttattggaatcatggttggctctttctacatccctgggggctatttcagctcaggtagggttcaccattgagggggttaattttaaactatataaactctatagatgattgagttaaagctacattttaggccgggtgcagtggctcacacctgtaagctcagcactttgggaggccaagacgggcggatcacctgaggtcaggagtttgagaccaacctggccaatatggtgaagccctgtctctactaaaaatacaaaaattagccaggcgtggtggtgcacgcctgtgattccaggtactcagaaggctgaggcagcaaaattgcctgaacctgggaggcagaggttgcagtgtgccaagatcgtgccactgcactccagcctgggcgacagatcaagactctgtctcaaaaaacaaaacaaaacaaaactaccttttaattactgtttttgtagaactgacaagtaaatgagatggtatccgattaatatgacttagtacctgcaactcactatatatatatatatattttagacagtctcactctgtctcccaggctggagtgccgtggcacgatctcagctcactgcaacctccacctcctgggttcaagcagttctctgcgtcagtctcccgagtagctgggattacaggcgcccaccaccacgcccagctaatttttgtattttaggcagagacggggtttcaccatcttggccaggctggtcttgaactcttgacctcatgatccacctgcctcagcctcctgaagtgctgggattacaggtgtgagccaccacgcccggctgcaactcattattaatatgtggatttaggtcaggaggcattcactgcacctctcagattttctggaaccatatgttaatcttttggcaatatcttaatagtttgtgttctcacttgatggaatacaaagctaatcagagagcctgtcaaaataaggacttacaactcttgtgctcccctatctctgtcttaacctacttcctaagcatggcatcaggtgacatctttagatttctactgtgatttaaaagaaaagacttatagtatcatttggaactcaggtcccaggcttcccttggcacaagctaaaacatattttaaaaggtctgaaacccagtagaaagcttttaagaatgccgttgagtttggaatcttgctgtactgctggagacagaatgtctttaccacctctgtcttgttttaattgaaatccgttcagaatgttggatcttctgaaatgttactctatggtagagaataactttgttctcttggttcttgtagtctggtttgttgttggcatgataggggccgccctcttcatcctcattcagctggtgctgctggtagattttgctcattcttggaatgaatcatgggtaaatcgaatggaagaaggaaacccaaggttgtggtatgctggtaggtatctctactcacctatgttagccatactgctacattaagcacggtgtacaataaaaatcatcattatagtcccagcagctatagtcctcagggacagaagtccaaggtgggagaatggcttgaatccaggagttcaagaccagtctaggcagcatattgagactccatctttacattagaaaaaaaaaatttgccaggcatggtggcatatacctatagtcctagctactcagcacgctaaggcaggagaatctctggaatccaggagttcaaggctgcagtaagctatcatcatgccactgtactgcagcctgggtgacagagcaagaccctgtctctaaaaataataataacattaaataaaaggaaaaaaatccacaatttccagaatttggctctgaattatatgcatcactggaagaaagtagcacagataatataaattgttcgattttcccaatttatgtattttgagagtcataatttaattacatgtgtttagataaggaaaaacagttatatttagtgacttagttctggttttgataaccttgtttccatggagaggaaactcagatgggttcaacatatgggacagctgcccacctactttaggcagataggagtgagtagtccttatggccttattcagagaggggccccatacctgctatgaaaaactttctggtgggaaaggggcacttacaatttctagagtgataatgggatttaacagtagcttgcgaatatattttggctatgttagagcacttactacttcataatatacatttgcacacatttctgattatttccttaggacagattcccagaaatagaagagtcaaagtgtatgaatattttaaaatgctttcagtacatactattgaattgcgcagttttattttcatttgatttagttttttaaaatatttacatgtttttaaaaatactatgtttaccataaagacaaatgatagaactttataaagactaaaacatgcaaatctccacctatctgcaacccattttcctttccagatgtagccactcttgtgaacctttatgtatttatgcattcaccttgcttttgtatttaaatgtaaacaggattgtactgtatgttgttccatgacttgctcttttcacttcctacatgatgaatatccttccttaccagtgagtgtaggtatgtcttactcatttaacctgcattcaagctcctggcatggagtttactgtaagctgcatggtattccattccatacaattccatggcattccatagcggagtataccataatttatttaacctttaccctagtgttggtcatttaaattgtttgtaatgacaattttatttttatctattttttttctttttttttgagattgggtctcactctctcacccaggctggagtacagtggcacaatcatggctcactgcaacctctgccttcctggctcaagctatccacctcagcctcccaagtagctgggactacaggtgcacaccaccacacccacactaccacgcctacaccaccacgaccggctaatttttgtgttttttgtagagacagggttttgccatgttgccggaactcctggactcaatcgatccacctgccttgccctcccaaagtgttaggattgcaggcgtgagccaccacacccggctgttattttctttaattcattttggatcatacaactctagaagaatttattgagttgcaaattggtcatactttacagtaactaagtgtagaaaaatcttgtatattcagaggtgaaaacattaagtgtgctagtaacttaatgtacatcatttaattttagacatgcaaaattcattgagataagtagaaactagttttcttaatctgggctttgacttgaatacaagttagctgagctcatcattcttgcagttggtctgagtgtactgtatgtgctgtttcatgttttctaattttcagagctacacagctaattgttttgtttgttgtttgagatggggttttgttctgttgtccaggctggagtgcagtggcaccatctcggctcactgcaacctctatgtcttgggctcaagcaatccccctgcctcagcttcccaagtagctggggctacagccttatgccaccatgcctggctgatttttgtattttttgtagagacagggtttggccatgttgcctgggctggtctggaactcaggctcaagcaatccagccaccttggcctcccaaagtgctgggattacaggcatgagccaccatgttcagccaacacagctaattgttgatttttagtgtgaatggaaaagaccattactttagatattaaaaaatagcaaatgagccacttttccagttcagggacagtcttattgtttgtgatgggaaatggatttagatagccaatggctgcagaggaaaaaactgtcataaaaagataccagtgtgtgtattctgttttcctctaacaccatcctggcatggagcttgctgtgaactgggtcattttgagggtaaaggaatcatttaggttcctaagaaaagctcacaatacacattaattaacatataggtagcagtaaactctagctggaatgatcaaatgtctggtaatcaacccatgaaatcaaatcaggtaattcaggaagtgaattcagttgcttggtggattttggaatttaacatcaagccaattgaatacaatcttgatactttaaccttgagacctctgtaattttactgtaaattaccccagaaaagtgacataatgtctcctcatttttatatggagtggaagaaaattggccttcattattagtttattatagttgtggtcattcatattggtttccctttctccagctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggtatgattgtttactacttctttctcctgtgaaaggtttttaattctaagcttaaaatctaggtaccctttcttatgaatttatgtctaagtttatccacttgaacatttttccatattataaagtcttcataattctatttcatgcctatatcataattaaatgaatttcactatcattaaaaaaaaacccaggtaacttgaaaatttatagtgcttttttttttttttttttttttttttgagatggagtctcgctctgtcaaccaggctggagtgcagtggcacaatctcggctcactgcaacctctgcctcctgggttcaagcagttctctgcctcagcctcccgagtagctgggatcacaggcagccaccaccgggcctggccagtttttgtatttttggtagagatagggtttcaccatcttggccaggctgaactcttgacctcgtgatccacccgcctcggcctcccaaggtgctgggattacaggcgtgagccaccacgcctggccgggaatgagtctttttttttttttttttttgagacaaagtctcactcttgtcccctaggctggagtgcgatggtgcaatctcagctcactacaacctccacctcctgggttccagtgattctccagccttggccaggcgcctgccaccatgcccggctaatttttgtatttttagttgagacggggtttcaccatgttggcaaggctggtctcgaactcctgacctcaggtgatccacccatctcagcctcccaaagtgctggttttacagttgtgagccaccgcatgtggctgggaatgattcttatgagtcattagccaagatattttaggggaattaaactgaaaaataattgattttaatatttcaaaacaaaactcatgctcttgagttctaaataccatagtttaggctgggtgtggtggcttaacgcctgtaatcccagcactttgggaggccaaggcgggtggatcacttgaggtcaggagttcaagaccagcctgaccaacatggtgaaacgtcatctctactaaaaatacaaaattagctaggcgtgggggcgcacacctgtaatcccagctacttggcaggctgaggggcaggagaatagcctgaaccctggaggcggaggtagcagtgagctgagattgcgccattgcactccagcctgggcaataagagcgaaactccagcttggcgtgatggctcatgcctgtaatcccagcactttgggaggccaaggcgggcagatcacctgaggtcaggagttcaagaccagcttggccaacatgacgaaaccccatctctactaaaagtacaaaaattagccgggtgtggtggcgggcactgtaatcccagctactcaggaggctgaggcaaggagaaatttgaacccaggaggaggttgcagtgagctgagatcgcaccactgcactccagccggggtgacaaaagcgagactccgtctcagaaaaaaaagaaaaaaaaaccgtttaaaaaaattcatggagttatagatatgaaatatgaaaattctatctagacatcacctttccttttaaaagtgagaaaacagaagtctcaaagaagtgataggcctctcccagctactaattagttgcagagctgatcttagatcttttcactacaccaagggagtggaaaatcaaagtccttgtgtgatgcacaggaatttctaggattgtgaaatgcgttgagaaccagtagtacttgcttggtctttctgggttcttttgcgagctaactgaacagaaggttacttgtcacctttcaactctcaagaagaatccgaaagttctcagttactgatagttgaattaactccagagaagtgcactgcattttggaaagtcagcccttggcagtccctgtgccactgttttccttttgattccataggaacaccagcctcgctccggcctcttgcagtcctccctcatcaccctctacactatgtacctcacctggtcagccatgtccaatgaacctggtaagggaatgtcaataacacattcatttgataaaaagaaagtaggaaatcagcctttacatagttggtacaaaaactagagctagagcaaatgtgaaacaagcaaacaaaacttaaacgtacagtgttcactgtaggtttgtaggtatttacctttcacattttagtccccacatctattgatagctatttataactgacagtctaaagggtcagagtcctttagatggtctaggctttacctaacctaggctgagtcaaactagttaagagctgtggtcaagggctttggccctttgttgtgactgaattttagtttgatgtcacaggctgtagaagaaacagctgtaggaaatctccttttgtagttattataggattgtttctcagtaggatattctatgggcttcttttaaaggaaaacaatgcagaccccccttccaccaatgataacttatattttgttcttaagtaactatgtaaaaaccaaaatagagataaacttctgtgcttaaaaccttgacacttaaagaattaaaaagatttgtcaaactacaaaaccaataaaatcaataatgatgtttatgaaatttgacagattctgttgttgttttctttttttttcctaattctgtcattgattgtgaccaaacgtgttactactgactgctaagtttcagattttttaagtaaagcattcccatgtttcacatcatgactgaatgatatgtagggaactcctcaagttctttcttggaacaagatgagctgtaaccaaggataatacaaattttctcattttcagatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctaggtaagttaaaaggtacttagaacaagattttcatggaggttgataataaagtgaagaagctgttttgctttcaaaaagcagcatgagaaatttaaaaacttcactctctttaatgaaaagttctttacttgcttcagttacagagctgtgtacatatatatttttttgagacagtgtcttgctctgtcacctaggctggagtgcagtggcaggatctcagctcactgcaatctccacctcctgggttcaagcagttcttctgcctcaggctcccaagtagctgagattacaggcacctgccactatgcctggctaatttttgtatttttagtagagacagtgtttcaccatgttggctaggctggtctcgaactcctgacctcaggtgatcctcctttctcagcctcccaaagtgctgggattacaggtgtgagccaccatgcccagcctgtagtaagttttgaaattaggaagtatgagtcctccaaatttgttctttttcaaaattgttttggcagttatgggtcctttgcattcccatgtgaatttcaggatcagcttgtcaatttctgcaaaaaaatatgtagctgggatttttatagggattgagttgaatctgtatagaccaaattggggagtattgtcatctcagcaatattaaggcttccagtctgtgaccatgaagataccttactgaagtcttctttacttaaaccatttatttaggtctttaatttctttcagtggtttatagttagttattagtatacaaatcttaaacttattttgtttttaagtgttttattctaaatacaattctaagtattttattcttttcgatggtattataaatgaatgtatgttttcttagcttaacttttgggttgtttattgctagtgtatagagatatgattggtgacgaggcatggtggctcatgcctgtatttcccacacgttaggaggctgaggtgggaggatcgcttgcatccaggagtttgagaccagtcagagcaagatagtaagagcccgtctctataaaaattagccaggtgtggtggtgcaatctgtagtcccagctacttggggaggtgggaggaccaattgagcccaggaggtcaagtctgcagtgagctgtgattgtactactacagtccacctgggtgacagagtgagacctcatctcaaaaagaaatacaattgatttttgtgtttttttttttttttttttgaagagaagaagtgttgctctgtcatccaggctggaatgcagtggtgtgatcatagctcactacagcctcaagctcctggtctcaagtgatcctcccacctcagcctcctgagtagctgaaactacaggcacacaccatcatgcccagctaatttttaatctttttaggaacagtcttgctgtgttgcactggccagtcttgagctcctgtcctctggcgatcctcccacctcagcctctcaagtagttgggattataggcgtgagccaccacacccagtcctgatttctatatattgatcttgtatcctgcaactttggtgaacttatttattggttctaatagtttgcatgtgtatgtattccataggatttcctataaacaagatgaagtcatctacagatagagatagttttacttcttttctagtctggataccatttatctcttctatttgctctggctagaattttactacattgttggatagaaatggtgagagtaggatccttgtcttgttcctgatctcagggggaaagtttttagtctttcactgttaagtatgatgttagctctgggttttttgttccttttgtcagcctgaggaagttctactttgactgtttttatcatggaaaggtattggatttgtgagatgttttttctgtgtctgttgaaacgagcatgtaatttttgtcctgtttttgtatttacatttttattcagtcatttaacaaacttttagtgaacatctgtagtgctagaattacatagactaaggtcactgttaaggcattctttgaatagcaaggaagataggagtgatatgtgcagtggcagaaggaagcctaggaagctgtgggaagtcggaggagtgtcttgtaacctagccagtgaggggtgatgtcagggaaggccttccagaggacatgacagcaagtcagagaagtgaaggatgagtaagttagttggaaggaggttggcacgtggtaccttccaatcatagaagcggcacttgtgaagtcacggaaacagacacagagagcatagtgtgttttatgaaactcctaagcaattaagccatcacatcaagtagtaactgatgacagtgacgtcagtcttatgatgacaggcagcagttcagaactttaagcaggatcttcagaaagctttcagtctccaaagtaggaacagctcagcagtaagtgtcttgtatacaggccagtggcagcagttcattgtcatggcccctttctgatttgtcttccttgggatcactttccagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacaggtaggagacacagacaaaacagacagaagaccataaaacccttggatggcctataaaatctcatccattgtcctgacctcagaacccttgctcttacccatataatgaagttgggttaaatactcttgactttatcccctctagcatttaaaacccattggaattctttgcaatgcaaatcattgggagctcttacagagttgagttaattgagagagaaaatcatgacataaagcaatctgacccatctttgttcactaattttctgtgtatagagatggccatgtcagagcattctggttcccgtaataatgtactaaggaaggaaagtttcagggaggctatctcaatctagacctttgccagtaactaggaacatttaaagaactttgccctgatagggtctttcatgctggcaagaagaaaagtcatttgagaggcagagtcaatgagctgtttagttcttggtcataagaactaaaaatagcagcttcctctggtccccttcaaccctactggggggtagtgccagccaagtttcactggagaatttcttggccttggctggggggctgcaggaggctgatagaagtcaggtagaccaggcttttctacctgactctctcttgttttcttagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactgatattaatttgaagtaacaaatgctctttaaaagtcgggaggcagtgtccctgctttgcttggtcctaccttaagaagtagtgaagtctgcctcttagtaggaaaaccagtagtctaatcaagactcaagtgaattatacatgtgaatgctgaattatatacaagcatgagtaagacagcattctgaataaggccaggatcatcatttaaagcaggggagtattttgagtcatcagatctcagggtggcctttcattccagatgagtacctttatgtttcatcactatgaaagggcttgcctagccttggggaatgcgggttggggccctggctttcagatcagggacatgctctaggaactcatcaaaggcaatagcagtggctgccacttttacctcgttaaagccgggagaaagcttctaggtccatgctggactcctttattttctaggttggtcttgcgggttatctggttgggaagtaaaactttctcttggtaatcaaagaaactgcctgccaaagagtagccatggacctggttctcagtatagaggttttgttctttttctttttggctagccaagtgaggaatggagaaggaacaaagaaatctgtaactggttcttttttctttttttagacagagttttgctctgttgcccaggctggagtgcagtggtgccatcttggctcactgcaacctccacctcccatgttcaagcaattctcctgcctcagtctcctgagtagctgggactataggtgcgcgccaccacacctggctaatttttgtgtttttagtagagatgggatttcaccatgttggccaggctggtcccgaactcctggcctcaggtgatccacctgcctcagcctcccaaagtgttgggattacaggcgggagccactgcacctggctgtttttacacattcaggctaaagtgagtattcacataatgagttgtgcatttgatctgtgcagattgataacagatagtaggcttatgcttattaatggaagctgctgttcatctctttactcctgttgtgttggtctgtccgtcctgttacctaggcacccaactcagtgatgtcctaattactgctggatgactcaagccacaccatgcctatgttctcaggtgaagaagaataatagaaaccacatagatgggtaggtgtaccaagcattaaacagacagtatcc

SEQ ID NO: 37555 - DNA, 41607 bp, Homo sapiens
tccagggcatccctgaccagacgcgcccccgcagcacccggcagctggcacacgtctgacgacctcctggaggagggcgaccgcagcgacacaagaggctgtgccggttgtcctgggcgcacccgaacaaggccttgggaagggcagcgcgccccgcaacgtgagcacaactgctttacaaacttggcatattttaccaactccccctccttctctccctctcccctccaggcataaaggttgataggaacaaacagatataataataaatgcaaagctttcctacctccccggtaggggcggctagaagatgtagccaatgttcactatgctagcttcctggaaaggtatttcccagtctcagaatttggggatcgggtggttaggagaggcaacggtgggagtgggcgaggattgggggcttgttttgaagctgcatttgcataatatgctcctggcttttgtttctattgtgtgtttacttggggtgagggggctctcggggggtgcaacgtcttgtgaggagaagctgctttggcggggcaaggcttgtttttcttagattgtatgatactagtcagaaaaataacgtggtctaaagatgccgaatttttaaatttatttttactgcttatggggggggggtgttgtagctgatggaaagcttaagcccctaagcccccaccccccattattaataatcagaatccttggaagtctcccgccgcctcccccttctgaccgcccagatttcatcaagccccaggaaggctccacaaggtccaggggaactgagccattttctggctcgtcgaagacaaatccaccgggcgggggaggggggcaactcgtgggaggccccaactcaccggaggggtgccctgggaggcgaacctggggtttacctcgaagagctcgcctcgaggtgcaggtgatgggggaatggggcgggggttgattaaaaaatgttcttcctttcttaaaaagaggagggggaagaacagactttaaattcttttgcaaacattcatgcctaaggaagggctggaacaggcagccccggccgccggaaccggtcggacaggtagcgagcttgttgacaccgttatgttgcagggcgcatgctcagtcccaagtttcctggtgccttttctattccaccttatgaaactttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccaggtgagcgcgcgcgggggccgggcctgggcgctgggctcccggggtgggggaaggggtggcgggtcttctctgctcatcggcaggggcgggctccccacctcatccccctcttccggggggcacgcgggggtcttctaggcgggttagggcaggcaatgagggactgggatgccccagactctaggcgcccccttccccgtagtgggagcctctaattgcccggcggcgggaccgttggctgcagcgcgggccaaggtggcccaggaaagggattgaaagccagcagaggctacccccaatctcacgtcctcatgggggtgcacaaaggctcgccaacccttctggggctagctggggagaggtcagatccgcctcccccgccctgagaggaaacttggcgcgcggggtcctccgccgctcgtggccgcccggttcctcgtgggcgccttggctgggaccggaaagaggctccgagcaccccaagctagctctgtgggccgattcggggcttactggcctcccccgcgacgttgcccacttggcgaggtgcccaggtccggggcggggcggcggcagcaccgcccgcaggtcaaactgccgcgggcgtgcgggttgacgccgagtgtgtgtgtcggggcgcggcccctccctccacagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaaggtactgtgtcgactctgcccccgccgccacctgcaccacgccctggcgtcgggctcccgaggccggcgcccctccctgccgcgcccgcctgcgcaacccggcacccgcgccccgagcgcgcccgccgcgccgctcctgcacctgcccctgggcggcggccagggcgcctcggcgcgtcctcccgcccgcagggtagctgctgcgcaggggcggccggttcccggagtgggctccgtcctcccggtggccccgcctgatgccgagtgctgcctctggaactgccgaaaaggcacaggcatcactgccttccgccagcagcccgttctgtgcgctaggcctgtagaataaccaaggccgtcggagttcctgaggttggaaaggaagcctcagcgctctcagaaattccaccctctgggacgcagttcctggcgccgcgattctgagagttcaccccccatgcttatgttctggacctgggcggcagcttgacacatagtgggcctctcccaacatgaaccggttcccagtgtctgtcagacaggaggcttgtgcacggcactttagatctgtcatctttccaatcttgaattaaattgatgggtaaaagggttcaactacagatttctcgagcgcccctaccccagtggattggagtgtttcctcccatctatggtcgcgcctcggggccccctcgaacattctggacgcccacctgcgctttcgggcagaacttccatgatggtctgctcaaaggtatccgctacccaccaaggtttaggaatcccattccactgactcagccagctggagctaggaggtggtggtttatgatcacttggcccctctttctagcctggtgggccgcagtgctacactgtgcaccccctagacccccggtgcaggtggtaattccagggctctccggtgccctcctgccacccagaccgggagtagagggcggtggggagggagagcctgggctttgctgtggattgagaaaggacccctcattttcctgggagaggtcccctatgcacattgcgtattcccagggtttgactccggggtgggctgaggcgcatttggttttgaactgaggtttgaggcttcagctgggatccaaaggaaagacctctttaaagaagaagctgccgaaaccgtgcgggccggcagcttagcggtaagtgtgagggtgaggttcaaagtcagctggcctgaggctcttccgggccaggtggggttaagtgggagggaaaaatttgcctgaggctggtagctctgcccttcgggagattctacaaagtgccccacttgcatatttatcaccaggctggaaggacaattgcaacgttgttttgggagcctctgcagctagtttgcccctctgtcccccaattgcccagattcccctggagagaaagtgacagattctcatccagtctcttaacaaatattttaggcaaactcttctgcctcaggcacacagggccgttggaatcctggattaaaggaagacgtaaaccaatcttatttcctagattagttgcctgtgtgctgggggaaggggggcgggaggcacagttcactcctgaaccgttaagagtcttctttccatagtttccaggggaatttttatttactggggatgtttaggttccctctttctgcctctacccccaaaaaggaaacattttggtgttaatatgctccaagcctccagaattattatcagccatggcattggcagttttcaaatgactgaccaaattgcctgtgacttagcacgttgtataattataaagttctttccaaggcatgctgaactcacaatttctctaagaattagtttcttttcttttcttttcttttctttcttttttttttttttttgagatggagtttcgctgttgttgcccaggctggagtgcaatggctggatcttagctgagtgcaatggctggatcttagctcactgcaacctctgcctcccgggttcaagtgattctcctgcctcagccttccgagcagctgggattacaggcatacgccaccatcgccggctaattttgtaattttagtagagacagggtttctccatgttggtcagcctggtcttgaactcccgacctcaggtgatccgcctgcctcagcctcccaaagtgctgggattacaggcgtgagccaccgcatccagccaagaattagtttcttaggcagtgggctcccaggaccacaagaagggcaggtttgagctattgcctggcacagagaagcaacactctgcccgtctaacacctggggtgtgcaaggcagcaggaggtaaaaatgctcccaccctggtgttccttccagaatcatctggcagtagcggttaatcatataagctctggctttgtcacttcttagctgtggaccttgagcaagtggctcacccctctgagcctcggtttccttatctgtaagatgataatgatacctacttgatagcatcgtgaggataaatgagtggagggtagaacatggtatgtgcccaataaccatagatagtattcaggttaatagggagacacaaacattattaactctgctgcaggacagtgaatgtgaaaccagaattccaaacaaagacgtgaccgatttgagtggggaaagtgtcctgatgtggatttgaaggctggggagaagggaggcgggtgggcctgagggcagtgtgggctgagtcccgcagctggagcatagaaaggatgaagctctggtggctgaagataggaaacagggcttgctggggtcagggagagagttggcggtaaagagctggaaatgtaaccaggacagggtgagatggtgaaggggccaagccaagaaatatgggtgctcctgctgggcagaggagaagctctggatgatgtaagaaggaaaacctcaatcgggttcctcttttttttttttttttttgagacagagtctctctctgtcgcctggagctggagtacagttgcgcaatctcagctcactgcaaactctgcctcccaggttcaagtgattctcctgcctcagcctcccaagtagctgggattacaggcacctaccacaaagcctggctgatttttgtatttttaatagagacgaagtttcgccatgttgtccaggctggtcttgaactcctgacctcaggtgatctgcccaccttggcctcccaaagtgctgggattacaggtgtgagccaccgcgccctgccatttgggtccctcttaacggctgtgttcatggatcattatctcttctgagcctcagttccttgatctgtaaagtggaggactcaaagaatcagcctcctagaagagttgcatagattaaatgagatagtgggtgtaaagtgtttagctttctgtgcatgtgtaaactgcccaagaggaagttagctgacagtgacatacagcaagttttaatgcccaacattttgttggctgtaaggacatgggattcactaacttgatcgtgttgatgggtggatctggaaaaggagtccgaggtgcagattaggaaatgtggctggcccttcccagcctacctgccttttgacggtgtgcctcagggcagattgtgaaattgtctctttactactgagaattctgtaatttgccaaacaaataagggtgagaagatgatgtacattccagagagtgtgcatggcaggtcccttttgtgctggatccatctgcaggtcttcagctgcggggtagagaaacccaggaaatactaatcaccattgtcctttggaggcttattagaaagtaagtaactctgaagttggctgatagtattcatacgtgattctctggctggtaggacccaggtccaagtatggagtaccaagtgaatttgtcctctcaccctttcctattctgttctttctttttgtcctctcccatgggttcttcaaaataaattaagtttagattctttcaaaagtatgcttggccttttacccggctctctatcgagtcttgtagtggtgcagatgtgtgtctacggagtagtccccatacccccatcactttgtattatttacaatctcaaaggcatagtcatacgtatctgccacccagccccaacaaccattaacccatggccagtcctgcccagccacactcccaccccttgccccatgcatgattctgaagcaaatctaggacatcataccatttcaaccataaatagttcagaatgtgcgtttagtggataaagaccaaaattcatgatcacacccacattaccaattgtgttcacattactaattgtctcataaattaatacttttcccctccagtttgcttaatcaggtccacataatgtccacacattgtaattgattggcatgtcttttgagcctcttttaatttcatacattttccctccatcaagttaattgttgaagaaatgggtgatttgttttgtagagtccccaacagtctggattttgctgagcgcatcaccatgtgcctaatgtttctcagtcccctaggttttctctaaacggatagttggatctgcagctgcagcatccagtatcacatgtgactatcacagccatagtcaattaagaattaacaattagaccaggcgccatagctcatgcctgtaatcccagcactttgggaggccgaggcgggcggatcacctgaggtcaggagttcaagaccagcctggccaacatgttgaaaccccgactctattaaaaaaaaatacaaaaaaaattagtagggcttggtggcatgcacctgtaattcaggctactcaggatgctgaggcaggagaatcgcttgaacccaggaggtggagattgcagtgagccaagattgcaccactgcactccagcctggacaacagagcgagaccctgtctcaaaataacagttaagttcttcagtcctactagcgacatttcaaatgctagtagccatgtgtgaccagaggctaatgtactggacagtacagaatataatttttctgtcaccacaaaaagttctattggataatgcaactctccctgcttggtcagctctattttatttcagctagaatatgtcacactgtggggcatctgtcttcatcagaggcactgaatatttggttatctctctttttctgatgttagcagctgttgatgctcaggacctaaatattttggcttattaggtgttctaaaacagcaataatctaattctgtcctctgtttattaactgatgtatttctatagagatacactttgcctcatctactgcttggttttccagtggcacagttcatttatgaaaggcagaataatgctggattcgctttatttacctttatttgtaaatgaagataatcagttgttaaccagaattctccattgatggctaattagttctttcttttctttctctttatttatttttccttttgagacagggcctcactatgttgcccaggctggtctcaaactcctgggctgaaacgatcctcctatctcagcctcccaaagtgctaggactacaggcacatgctgctgagcctggctctcaatctgttatttcattcattttgttgtgaattatggattcaagccgtttttaaaaaccaattcatttgatatttggaagggaatataagctccatccctgactcctttcctcttgtttttttgtctcccaagacagacttgaatactcctccccctgctccactgtaacctgctgcccattttcctggctgcacatttggccaactgacttctcttttccactctagatccatcagagccagggaacacttcctactgggctcgtattacccagcaaccagtgcagtagtgcctgggtcatagaaggacataagtgaacacagaacaagaatttaggcaggggaagaagtcaacagttcccagacatgagtgatagcatttgaaggaaaacacagaaagcaggaagaaaagggatactggaaaaatgcttggaatggattcttgatgaaggttaaattaattaaaagggggaaaaggaggaatatgagaacaatgtgtattaattgcctggtgttaaacttgaatataggtgaagtaggtttttattgttggaaaggactacataggcttagttacgaacatcagaatccactatagctagtttaagcagagaaaggtattaaatggactaaagaaggaccaagctgagctcccaggaatgactcagagccacagagcagaactgggccacctaggagctgaagctgctgcccaatcaggaagctgccacctcgatggctgcccgtccctgcatctgccatggcaaagtgtaaaacaattgcctcttgcctgcctctgcccagttaactcggggctgaattcagatctcctgatagtgcatgtaactggtgaaacccaagttacttcccaaatcctcatggcaagggagtcagggaagcgtagttttcacttctctagcttcggcggtgcaggaaggcccaccaaaaggagttgggatagatactgagtccttccataggatcgactacaggaacctttaaagcatgtatggccccaaatctccttactttcagggtgagaaaaattaagcccagcaagtttttgttgagttcctcaaagttgttagtggcaaaactcaacccaaggatcctcaacctttcagcattgttccattgcattgtgggacaactgtactgtccagtatgtcagccgtagtcaatatgtggctttgatgctttagcccttagtgttgatagtctgacattaaggactcatgatgatatgagacaaacaatggggttcatgccccctcctcctgccccacagacctgtgggcctgtcctgagggaactgtaggcacaagttttgcagatgacggaccacattcaaaattctcagggttggccactacaagtcatgtggccgtgggcaagtcatatctctttgggcctcagtttcttcttcaggtttataaagatatatattcccttcatcttctctgcatttgagaaggctctccattctgccatgtaggggagttgtgaagtctaaggaaatggtacataggatcggggggggaatctgaatgccaaacgaattggggaaatatgcttagcatgcttttagcattcaagcatcgcaccgtgtcggtggaaatctggtccaaatggccaccagaaggtagccttggactcagaatatcctcccatagaccattaactaaatgaacttgtctgctagaaacatcaacagaaaataaaagttgttcttttttttgtcgttgttttcacctttagaagtttgacaggtgaatgatctgagccggctttgaagctggtcagagggccagccgaaggccctgactccctggatgttcctgcagttttcagcagtgcggagacaatgattggtttgttctgccgctgagtcctgttttctagaagaagaacttgaggagaattttgcacattttttgaaatgaaagccgagatcctgcagaaaacaggacagtgctcagaaaagcgccaggccatggggttggagagctgttcattgtctcttcgtcttcgtgccctgaattaatttcaagaccaaggtcatttccctccctgtatggtagtttccccacctcgttaataagccttttgcaaagtgttaattttggattaagggtgagacgattaagcttttccagaaggtagcatggtgtaaaaaccacccctggcaggcttggagcagtaccttataattaaatatattaataatttccatattaaaatgtgaatattgacactaaatgggataaagtctgcacatatttttacatcagctcaggtcagatttcactgtcacgggagataggagagaatgttggttgtcagagctttttgtcatatgttttgttttattttattttattttttgagacagggtctctctctgtcactcgggctggaatgcagtggtgctatctcggcttactgtaaccgccgccccccacctcagcctcctgagtagctgggattacaggtgtgcatcaccatgcccagctaatttttgtattttagtagagtcagggttttaccatgttggccaggctgatcttgaactcctgacctcaaatgatcctcctgcctacacctctcaaagtgctgggattacaggcatgagccactatacccagctgtttttcagagctttttgaattacagagttgcagatgaaggactgggagctagtggctccctttttagtttcgttttgttttttttagttccccttttcttccatcaaagagagaaaaattcaaaagcaaattgggaaacaaatttttttttcttcttttgagacagtcttgctctatggctgaggctggaatgcagtggcatgatcttggctcgctgcaaactccgcctcccgggttcaagtgattctcgtgcctcagcctcctgagtagctgggactataggcgtgcaccaccacaactggctaatttttgtatttttagtagagatggagtttcaccatgttggccaggctggtctcgaactcctgacctcaggtgatctgccccctcagcctcccaaagtgctgggattacaggcaggagccaccgtatctggccgagaaacaagaaattttgaccaattaccttttgtttaggaccacagaattttggagttggtctaactataataggacttacaaagcaccaggttaattaaattaagatttaatttcttcatttctttcttttttttttttttttttttttttgagacggagtctcactctgtcgcctgggctggagtgcaatggcgcaatctcagctcactgcaacctccgcctcccgggttcaagtgattctcctgcctcagccttccaagtagttgggattataggcacctaccaccatgcctggctaatttttgtatttttaatagaggcggggtttcaccatgttggtcaggctggtctcgaactcctgacctcagatgatccaccggccttggcctcccaaagtactaggattacaggtgtgagccactgtgccctgccaatttcatttatttctaagagacagatattattattatatttatttatatttatttattttgagacagagttacagtcttgttgcccaggctggagtgcaacggcacaatttcggctcactgcaacctccgcctcccgggttcaaacgattctcttgtttcagcctcccgagtagctgggattatgagtagccaccatgcgcggctaatttttgtatttttagtagagacggggtttcatcatattggtcaggctggtctcgaactcctgacctcaggtgatccacccacctcggcctcctgaagtgctgggattacaggcgtgagccaccacgcctgccaatgcaaatattattattcacattttacaggtgatgaaatgaaggcttagagaagttaggtaacttgcctacaactaagttaggtaacttgccacaaactaagtggtagaacaggaattgaaggaattgaggaaactggaaaacagaccctgctcttagcttcttatactgctgaagagatcatctaataccattttattgttttacatgtggggaaattgtgacatagggatgttaaatgacattccatatcacacccctagccagatctaggttttttttttttttgatccttcagatttattgtctctctattccactattgttttgtaactaacatgactaagatgtaattaagtttagtctagtacttgtagaggaacaaggtaagatcgattaactcttttttaacttttaggaggtacagtgttaggtgtaaacctatgtaaacaaaataaaggtgctccagtgagcagagctgtgatcctgatccaggcggggtcagctggtcctctgccccatgagacatcagtccaggagtcagatgtgtcttctgtaccatgcagtcctgggagagacacttagaaatgtggcaggtctggcgtctggagagaatgatacgtttattactgttccagttaacctatttctgcttcacaagaatctccaaatttaatagatgaaatgatgtagtattgtatcatccacctctgtgggatgactgggcttagcagggcagttcttgccttgtggttgcagtcagatggcggctgaggctggagtcttctgggggtttgactgggatggacatccacaagggctcactcacatggctggcaggtgacacttgaactgcttctagcctcttacctttgtccagtgcattaattgtaaggttctgccaccgttttttcacaagttcctattgatagacatgtatttagtttccagtcctttgctattacaaaccaaatttcaaggcacaaggcatattaaatatacttttagggataaatttcatgtttaggaatttacaaagatcccttcctttctgagaagtgaaatagtctggcagaagctagctttgtcagccatgattttttgccattaaataaccttacatcttctttcaacaaggctcctgaagactttgagtgtaatttgttaatatctgatggctggattggtcataagggtggtaagcagcacttaatggattggagggtgtgccacaggatgaattccctacctgagccacttcttggtgactcagctttccatgctgtgaaatggggagaaatggaaaaattgcctttgctgagggatatgtggagaatttccatttttgctctaagaaaaccagaggaaacgtccccttgagaattaggtgtgccttcagtctccaaccccttctctccactcccattttctcccctgttttataaagcttcctggcaagtcattgtggctcacgcctgtaatcccagcactttgggaggctgaggcaggaggatcccttgaggataagagttgaagatcagtctggtcaacatagtgagattctatctctaaaaaaaattaaaaacaaacaaaaataaataacacactttctatgtcttgatcagatgatctactggccctgtactcccttaaattgtcactgatctcccttccctgtgcccttcaagatcttattcttttcaaacaaaataataccgacgatttgagattttcattctagactgcaatagaaggcatctgtattgcattcagagcattttaaaaataggaatttgtcaaaaagattaaacaagaattcatgtttgaactatggttggtgagtccttaggcacattctgcaagactttcaaaagacagttgcaggtttttactaattttaactggaattaccagggtaattgtctttgttctatttcattagcccctcactaccactcaaatgtgcttgtgcacacttggtctttagaagctcaaagtacttagtggagcatatttagtcttttcaaatcccttcaagggtggaagtaagcaggatggggactgccgggcaaggagaacatgaactgcgtgggtgataggaaagccttgggtagaggtgggcagctgcagttctggggagtgaggtagttgatgaggatccaggacagccacccaactgggtcatcgaactcagcccctgtgatgttccccctttgtcttccagtggctccctcttgccctttgactacattccagctccagtagggccctcaaggtagactcctaaggggatcttgttcttctcagctaccactgctctcttcattaactgctctcccaggctcaggctagccatgctgaaccacacacagttccctctttcccattgtcctctcctggaatgttctttgctgtgcaccccttttcttcctcatctttgcctgactaaggagctcacttcctctggaagcatcttccctggtgctgtaggtctggggtaggtgccccctcggacccctgggcctctcagatgtcaatggctgttgacttgcctgcacccccactagactcggcagcttcctagggactggggattaagccatctctaactgtattgcctccagctctaagcacagggcttgtcacagatcagggacttatcaatgttagctggggcaaattaagctccaagcaaaggaaaatgaactagtggaggaggctgactggaataccctgttctggggtcttgtgcctcccttgagactctctgcatcctgccacctgctcccagctgccggtcagcacatactgattgtgcactggccctagactaggcttggagcagtgggtagggaggcaggaatgggaccgaatgcttgctgaccatcctcaaagtgttgagttgagaaaacaagatgaactgtgtgcatagtgaaacttgggaatgagatggaatatagcatgacttctcagggctagtgtggcgtgtgcatcagctgcagtggcatctcctgggctctggttagaaatgcagcacatcagaccctaccagacctcctgaatcagaacctgcattttaacaagaccccaggggaggcataggtatgctggagtctgagaggcactggtttaagtgggacagtgagcagtttagtcatgggctgcagtatttggagaaggctgcatcggcaagggagcaactgagctcccttgagtcctgggagggcaatacccagggtggatgaaagaggagagtatttgaagctgggagagtgtggagccaggagaggaccagtcttcttgctagtgatgaattttggcagagcaatgggatccatcttctaaaggatctgatttggtaacattcacatcacatgttcaaaagttaccaaatcagatactaaaattgaacacatcatttttatcacccagatgtagattctatgttcttccttagcagcagcgaaggtggtagaaagcactgggcagggagtccagacccaggtctggttgtggttttgctgataacaaagctgtgggtactgaccaagccgctttacaaaatgataattttatgcgtttatgatttcgtgggtcaagacaaaagccataggcatggctctgctaggcagttctactctgggtagtgttagtgggggcgactcattcagctggtggcagccctgagttgggatggagagtccaatcaggctttattcatatctggctcctccgtgctcccccatgtggcctttggctgtccacatggctagcttgggcttcctcacagcatggtagcctcagacttcttatgtggcagctggcttataagagggaagaaatggaagctacaaggtctcttaaaacctggaactgacacatcttcattgcattctgttgatccaactggtcataagccctgcccagattcaaggggagggaaaacagtctccatctcttgataaatggagcaggatgcaggcacaaggaggacagaattgagtgtggctctctttgggtactgtctgtaatataacataccaggctccatgatgtcatgaggacccagactcctttctgctcctcccacctcatggtccaaggtgactgttggtgctctagtcagcaggaaggagtggaggaggaagaaggcaccgtttgctccccttcaaggagatttctatttcattggccaggtagtccatggccatgctgtcttagtccattttgcgttgccataaagaatacctgagactggctaatttatagagaagaggtttatggctcatggttctgcaggctatacaagaagcatagggctggtgtcttcttctggtgaggccctcaggaagcttccactcatagaaggcggaaggggaacaagcgtgtcatatggtgagggaggaagcaagagagaggggaggaagtgccgggctctttttttttttttttttttgagacggagttttgctcttgttgcccaggctggatgcaatagcccgatcttggctcaccgcaacctttgcctcctgggttcaagtgattctcctgcctctgcttcccgagtagctgggattacaggcatgcaccaccacgcctggctaattttgtatttttagtagagatgggatttctccacgttggtcaggctgatctcaaattcccgacctcaggtgatccacccacctcagcctcccaaagtgctgggattacaggcatgagacgccgcgcctggccaccaggctcttttaaacagccagctctcccatgaactgatgagagtaagaactcgctctttactacggggacggcaccaggccattcatgagggatctgcccctgtaacctcccacgaggccccacctccaacactggggatcacatttcaacaagacatttggaggggcctaacattcataccccatcacatgcctgtaggatgctgtaagacagtatgcccagctagaagtcagaggtttgttctaaggaagaaggggagaataaaaagtgggagcaactggctgggtgcggtggctcatgcctgtaatcccagcactttgggaggctgaggcggatggatcacttgaggtcaggagtttgagaccagcctggccaacatggtgaaaccctgtctctactgaaaatacaaaaattagccaggcgtggttgtatgtgcccctgtagtcccagctacttgggaagctgaggcaggagaattacctgaacccaagaggtggaggttacggtgagctgagatcgagccactgcactccagcctgggcaaaaaaagtaagactccatctcaaaaagaaaaaaaaaaaaaaaaaagggtgggaggaactgccagttgttacttcacctttcccaaagccaaaacctgcttgaaaattttaggggcagaagccgcagacagggcagcctcaagacacagggaggtgggtctcttgagtgagcctactggatgtgcctgcctgcccggggaccctcatggcctctctctgcccccagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggtgagcggggagtgcgtgctttgttctctgttttgttattctggccaagagctcctgtttctttcccaccaaaaaaccaggttgagaccgtggaacaatgttgtgtttctagaaagatcacaagatgcggatcacgaggttaggagtttgagaccagcctggccaacatagtgaaaccctgtctctactaaaaatacaaaaaaattagctgggcgtggtggtggcgcctgtaatcccagctacttgggaggctgaggcaggagaatcgcttgaacctgggaggcggaggttgcagtgagccaagatcatgccactgcactccagcctgggtgacattgcaagactccatctcaaaaaaagaaaaaaaaagaaagatcacaagatgatggggcgttagggccagcccttctgggttcacctcctgactctgccacctgccagctgtgtcaccttgggccaggtgagccacctttggtagcctgcctttcacccctgtaaaatggagatatcgatgtgagttctagcgaggctcaaaacggatccctggctggaagtattctgagaatcatgatgcatggcacacacgcggggcctgccacagctcagccccttggttctggctgctggaatgtggttcttgtggccccacaatgagtattttatacttctctcttgggacataagcctgtctctggatagcatcgtgttcctcctgagacacaaaaaggagctcattgcctttagagctgacccgagcctcgtactggagcctggcaggcaagcatcttcctcttctgggacctgcctcagttttctgacttaggaagtgggaatccaggttctccccagttccagttcttcacagagtcctgggggtgcccttggcctcttgtctcggcctcactgcttctatctgagaaacacctggcctccatgctttcccgcctgagctccattgtccacacctctgccagagtgatccctccaggagaattctaaggactctacttccctgctaagaaatctccaactctgaacagaatgaaatccagactcctcatctctcatcttgatgggcttcgtgtaaaggcctttacaatgtgggtcccatcttcaaatccccatcctatctcagcccatcccagcccatcacgtcctatcccatcacatcctatcacagcccacctcagatcagcccatctcactccaacccatttcagctcatcctatcccatcccatcttaacccattcaaccctatccaggttaccacccaccctcccaacagacttatagaatttactatctgcaggctgggtgcagtggctcctgctcgtaatccttgcacttaaggaggccaaggtgggaggattgcttgaggccaagagttggagaccagcctgggcaacatcgaaagactgtctccccaagaaaatttaaaaattagccaggcgtggtggtgcgtgcctatagtcctagctacttgggagactgaggctggaggatcgcttgaacgtaggagtttgaggctgcagtgagctatgattgtgccactgcactccagcctggacaagagagcaagacccggtctcaaggggaaaaaaaaagggtttgctatctatagtccccgagccctttccgtccttggtattttggtagggaagggaagacactttttcctccctccagatggggctcccagctactcagccctcatacaggttccttcttaggcctctgcatcctattttctagttcatatcatgcgtgtttgctcttagaggactggccgtgagctgcctccctggtctggaaagagtttctgtcaccttagagagtggctggaatcctaacatagttcttttctgttttcctcttttaaaactttttcttttctttctttctttctttctttttttttttttttgagacagcgtcttgctctctcacccaggctggagtgcagccaccaactcctgggctcaactgatactcccacttcagcacccctagtagctgggactataggtgcatgccaccactcccagctaattttttttgtattttgtattttttgtagagatgagatttcgtcatgttgcccaggctggtctcaaactcctgggctcaagccatccacccgccttggcctcccaaaatgctggaattacaggcataagccaccacacccggccaaaaactttttctaaagagacttttcattttagtgtaacatacatctagaaaagtgcacagatcctaagtgccgacctcagcaaatttaggaagttttacaaagtgaacacactcatgcgactagcagtcagaccaagaaacagaatatttccagccactagaagtcactacccctctcagtctgcctttttctctccaaggaaaaccactgttgcaaattctaacagcttaagttactgttgcctgtttttgagcttgatgtaaatggaatcccatagtgtgctctttgggtctggttatatggctgcttttcctagcaccagtgaatcaataaaagtttgacctctgtgagtctaagctggccattgggtgggggtgaggagaatgcttagggagaggtggaggatccatagggcagtagggggtcttataagaggcctaggggaggtctcgaggttgtcaagggacccatccagcagcagcaaagctgggctttcctcctgaccccaggggcaggaaatcaggaccactcctgaagtcgctggccattggtggccctggagggtgtctcagcccctccttgagggtgtctcaaggacatcatctctgaggatgtccttgagggcattccctgcctggatggactctgtggtcactcccccaccctggcttctaggacacaacgcagggggcccaggaagcatggctagctgttggtaccttcagctggagtaaacactgagctgatggccttgcctcccctgtgattgagttaattctccattgctggagactaagggaaatattagggactgacagcttctcagagaagagtttacaagttgaggcggtcacatagtagttaagaactcctgatctgagttagctgactgtgagacttgttctaaattattcgtctttcaccttaatttttccatctctagaatgggtgtgatcattttaatacttgccacttaaagtgatggttgtgaggttttggggccagaattacataaaagtgcttcttatattgtaagtgcgtagtaaatattagctattattagtagtaaaattgcaacagttggcagaggcttcctgaggacctgatgtgtaacaggccctaggattcacctctgtgctcatggagctctcagccaacatagggaggaataactcagacatctgactgtgagacaagtgaaacagccgatatgccagacagaagaaaaagtggcacatgccaaaggggagtcctgggaggtgccttgtttctaactgcatgtcaggggggcttcttagaaaaggtagtctttcagctgggcgttgaaggatgagcaagctttctacagcaggacagaaggaggaagagcgttgctaatgaggagtgtcttagtttgggttgcccaagaagcagacgcgacacaaggatttggatgtgagcaatgtatttgggaggtgatcccagaaaacacagtagaggagggaggggaggtcaggagggaagacagccaataaaagctcaataataatgagtgggttatcactacgggcagcggaggctcaatcccactggagatcctctgaagaaccatatagaatgcaccccaggttgctcaatcaacccccatccctccttgggtgtccatcctggacctcctgactcctgggcagttctccctaccctctgcccaccccagccctttgcaggcctggagagcatccttaggcagagagatgcaggaaccatctgagatgcctggcgatctgctaaggggatatgagtggggcatccgccctgggaggcagaagatttagcaagtgaggagggtggctcggcagagactaggggacccttcagagagtaacacagccctgcaggcagaagcaagccacacacggtcactctccttcatgccaggcctccggcctttatcctgtcatctcaaattacccaaagcagtcagtgctgttgttctccaccttttgcagaggaggaaaccaggctcagggagctcacacaacccatcagtggtggagctgggaaccagaactggctggccctgaagttcatggtcttttatcctctgtagggtctccttctctgccctctttgcctcccagtgccttcctcagcattccccctgaggcaggggcctcaccagcctgccctgttgcagtttctttcttttttttttttttttttgagacggagtctcgctctgtcgcccaggctggagtgcggtggcgcgatctcggctcactgcaagctccgcctcccaggttcacgccagtctcctgcctcagcctcccgagtagctgggactacaggcgcccgctaccaagcctggctaattttctgtattttcagtagagacggggtttcaccttgttagccaggatggtctcgatctcctgacctcgtgatccgcccgcctcggcctcccaaagtgctgggattacaggcgtgagccaccgcgcccggcctgttgcagtttctagaagcctgcttgcttctagaggaaggtgagataaagggaaactcagacctattagtagcacaaagtgcacacttcagcttggggtttagtaggttgtagaggagcctgtgagcgtgtgagttcagtggtgccaagatgtcctctgcccacagaggaagcaagaaagggggtgcctgtaccccttcagactcccaacctgaggttctcagattttctccatctcctactcttctagtgactcctgtgagggagctgaaaatcatttaagttagtgaatgaaaataccttccacctgacgttttcccaaagggtttcgcagttatcaccttaggggaaaggctagggcttaggaggcagctaggagtgaaaaacctagaggtgtgctggctggtccggcggccactggctgtgtgtggctcctgagtctcagaggaggggctggtccagattgagatgtgttgtataggcaaaagagacactaagtttcaagttgtaatgcaaaaaaagaaggtgtaaaaatctcaatttttttgtttttttcttttttgagatggagttttgctcttgtcgccgaggctgaagtgcaatggcttgatcttggctcactgcaacctctgcctcccgggttcaagtgattctcctgcctcagcctcctgagtagctgggattacagggatgcaccaccatgcctggctaattttgtatttttagtagagatggagtttctccatgttggtcaggctggtttcgaactcctgacctcaggtgatctgcccgcctcagcctcccaaagtgctgggattacagacatgaggcactgcactcggccaaaaatctcaatttttaatatggattttacattgaaatggtagtattttgggcataatgagttaaacaaaatatagcattaaaattcatttcacctgtttcttcctacctgtttgaggcttctacaaaacgttaacttataaagcagcttgcattttaatttctattggatggcactaagataacctttaaaaattttaatcatcattttgacacttaaagggatgaacaaatggaactatggaaatgttttagacctatttaccccatcccgacctattttctgatgaaggtgtgtctccatgtaataaaagaccagaaagagcagccgggggcttcctgacacatcagctggtggcaagctcagaggaacaggcttgccgagccatctcttcagctctgtccaaaagagacagttggtacaaagtgcaaaaatgtgggtttctcagatgatgttttagttcatgtgaacaaacttcaccagctccaaaagaccttacttgaattcagtgggaatttggtcttacctttgttgtttgcttatttgttttgttttaggtggagtcttgctctgttgcccaggctggagtacagtggctcccgtcttggctcactgcagcctctgcctcctgggttccagcgattctcttgcctcagcctcccaggtagctgtagctgggattataggcacatgccaccacgcctggctaatttttgtatttttagtagagatggggtttcaccatgttggccagactggtctcgacttcctgacctcagatgatcagcctgccttacccttccaaagtgccaggattacaggcgtgagccactgcacccgcctggcctggtcttgcctttgattgagctgtgagtgttgtatttttgctattggttcttataagtaaatgttgtatttaggccagaaacaaagatatagacacttaacataaatacgacagatagttaaatgaggggtatgtttgtttgcagtccaattagaccaggccatggcctggacccaggacccaggacccagggccgaggaccctttgttggagaattgtagctataatattgatgaggtgggcaaagacagtgagctagagaatcagggttaatctgcaccacccccgactcccccatctcttccaatcccctgcaactactgagcaaacaggatatctaaggaaagactcaaaacacaaagaaatatcttggaaaagatccagggaaactagaacctgaagatgtcttacattaatatccaagtagacgaaagaaaagattaggacttcttttttggctgtgagttcacccaagaaaggtaaatcggaggggtgtgtgtgtgtgtgtgtgtgagagagagagagagagagagagagaaagaggggaagggagtgttagttaaatggtgtcctactgaagactggaagagagaaactgacctgtgcagaaaaactctgtaatattttgtgaaaacaagtggctattttcaatccaaattatcttaggtggggtttggaagcggcttcccatcaaatggtttattgagggagggctgtcaagtggagcctgtgagggcagaggatgagcatgggttttgctgttagctggagtgcagcctcgacctcatcccaggggggatcaggagtgtgaatggactccaggatggatctgctacaggcaaggtgggggcagggacttttttacccccatttcagtctgacgttggctgagggctgtgtctgccctgggcgaggtcagggagacactcctgagcatctggaaggtcacttgcccagtgctgattccttaaagaaggggacagccagaagccacacgacagctggggacatgcactgacccagaaaagcggtctggatgggaagccagcagcagccactatataattgagggacttgctgtacttcagtgaagttgacaggatcactgaggacaacatgggaaattctgcctgctgaccagctcaaaatagagagaggggacatgagcttccaggaaatgaatgtgtattcagttcatagcctgtgaaaaacatgggcctttatatttataggatatatatagtatttataggacattctttcggatttatttaagtgttttaggttgaacaggctaggatgcttcctaagaatggttctctgttgaagtaaacgatttggtttgggaggagagggaggagatctttattttagaggaaaaaataataaccagcccttgcaagcacaagactctgcactgagtgtccacaccctccctactcaaagggtggtcagtggaccggcagtgccagagtccccaggagcgagcatgcaggaaatgcagactattgcttcggaagtgcccgatgtgccaggcccatcatttaagtcccgcgtttatggaaagtgttttattttgctcatttgtaaaatgactaagtattctgtaaaagatttcagacaatataaaaagctgcagagaagacagcgtaaagggccataaacaggtgagaagggcacacacatccgtggggctcccagctaaggctttgcagggagccacgtggcccagggaggtcataaacccatgctggttataacttaacaacgctggctggaataaaggaggcagttcagggctcatgccattcctggggaagctgctgagttccacagggtgaagccgaggaattccaattctgaggtcagggaggtggggagggggcaccggccccaccctctagggcgccttctgtccttatcttccatcggggcctacattcagagggaggagaaggcacacaaatcccatcttgattaaagaagagaaaacaatggtgtctttgtttggagcccaaagggaaggattgactagattgggaaaaatgcagattgggagatgtttggagtgggccagatggagaagaaagagtcaagtcacctccacccctagtggcctgaatgctgtcatgcggaattgcctggtccagttaacaaaccctcgcttcattgttttatttttaatttgtattttatcttaatttactttttagctaaaaaggtaatatgttcattaggagataaaaggaaagaaaaaaatgtaaactcccttcacatgccaagccccagttccaccatttaatttttttcccaaaagtttttaatgtatattgctttttcacataatatatatcttggagctaggtgcggtggctcacacctgtaatccccgcactttgggaggccgaggcgggctgatcacttgaggtcaggagtttgagaccggcctggccagcatggtgaaaccctgtctctactaaaaacacaaaaattagctgggcatggtggctggcgcctgtaatcccagctactcaggaggctgaggtaggagaatcgcttgaactcgagaggcagaggctgcagtgagctgagatggtgccactgcaccccagcctgggcaacagagtgagactccatctcaaaataataataataataataataaaagaaatcatgacaaaatttccagtatcgagggactgtacttttcctattcctcaattgatgacatttgtttccatttgcagatttccttccttccttcctcccttccttccttccttcctccttcccttccttcttttttcttttcttttctttcctttctttctttctctctttctttctctctctctctccttccttccttcctttcctttcctttctttctttctctttctttccctctcttctttccttcccttcttcctcgcttccttcctttcttctttccttccttctttcctttctttcatttcaggcaatcctaccatgagtatatcttgtatatccttcgcctccctgtgtgagtcttcctgtaggataatttccctgatgtgaaattgctgggccaaagggtagatacagtgtgatttttttttatggccattgccaaattgccttccggggaggctgccgtaaatgtccactcccacaagcatgcctgtaaaaatcttctcgctgaagttcaccttcggataaagttcagtaaaggagcagttgagctatagcaaggaaagcaactagaaagttccaaagtgtagaattttccttgaggatgtatggcacgaagcttgatttgctattaggggtaaaaaaatggaaaacaacaaaccctttttgataacccaataaacaatatttttcggactaggtaggacaggctgatggtacaaaattcaaaagggcagacggcgaaagcagtcccccctctcctccaccagccacattttaaaaaattatcctttccttttgttgtgaaataagtaacacgtacaaaagtatacatataggtacagtttaaagacaaatctgcgaaatactcatgtacccagcagccagcttatgtttttgttttgttttttttctgagatagagtctcgctccgttacccaggttggagtgcagtggcgccatctcagctcactgcaacctctgcctcccagattccagcgattctcctgccctggcctcccgagtagctgggattacaggcactcgccaccatgcccggctaaattttttttgtattttttagtagaggtggggtttcaccatattggccaggctggtcagcagccagcttacgaatgaggcttatctgcattatgttgagctgtatcccattgagaacttagtctatctcggctaatcctcacagcagccatgcaagagctatgacacccctgtgacaggtgaggaaacggcctttcgggctggagcagccgcccccgtttcagttaataagcagcagatccgcagcctggctcttcggtggccttggactcacagtcgtgtgggtgtcagtaggttaatgacgtctagcgcatgggtggtgctcttcagttcccatgtcctgctttagacacaggcacggttggcctttgcgtgagagcaccaagatgggtgagcctcagtggtgggaggggccttggcatcagtccgtcttgcccagggctcctctctggccacccacgtccccctgaatgtgtgggtgatgggggtgctctgggagggaggtgcttgttcccaagcctagaaagggtcaccaaggggctgccgcatggcagtgcccgcaccagtgaatgaggggtgaatggtggcgtttacactagcaaatggggaagcagaagtgctggggcacagagcagtgcatttggcaaaagtcagaagtgccataactggagctttctgggcctatgtctcctttccatctctgtctgcgagtcactcctcttccaagccaggctctaattctacccactccctggaaaaaaagcccccactgccatcatctctcttgtttgcatgatgcagggctttggaatcttctagcgtttgctatccaggccttgctgggtactctgctcatagaagatgctcagaggctgtgttgactgaagagaggaaggagatgtggccctgtgcacatggggctgagtggtggcctggctggcctctcctcgggggcagatcacctttgaggatgggaacctccaggagtttgttgcatccaggttaaagcctgatgttaagtgtgccagcttccccatatttttagtttggatgttttaaaacagtagtcggttatttctactaactagtgaaaggagcaactaatctctgggtggatttctgctctgatgagctgaaggttggaaatcgggtttgccgcttgatctactgggtagtgggagccagctgctcgctgctgcatgggcccagaaggccgggaaaacacaaagtctgcattacagtgcaaacatgaaagctagagcgggcgcattccttaggagaggagtctgtagtccttgcctatgtggaaaactagtcccaaagatgtggcctttctttcctggaaccaacagagttcatccattcattcgatattttgatttttaaaatattgccttaaaactttcttaaccttgattggtgagggttggtttgtttgttttctgtttttctgagacagggtctcactctcgcccaggctggagtgcagtggtgcgatcatggctcactgtagccttgaattcctgggttccagtgatctctcccaccttagcctcctgagtagctgggaccacaggggcatgccaccatgcccagctaattttttacttttttgtaaagacagggatctccccatgttcgccaggctagtctcgaactcctggactcaagagatcctcctgccttggcctcccaaagtgctgggattacaggtgtgagccatgcacccatcctagaatagttttaagagaaaaggtgggagattcattgtcattacactgcccagaaggaaccacagttagtacgaaaattattattattaatactggcaggtggttggagatgggaagtagtacagacagggacgcaatggcaagtgtaagccttcaccaccctccagaccgtctctccagaaccccaggtttatgtttcggaaacatgtacatccgtgcatatgccaatgtgaatgtgcatttatttagaactctcgttttcatacttggctgcacactagagcctcctggggaagctttaacaaattctcctgctcaggcaacacccagagatgacatatatttattaatcttaaaatacatatgtaggccgggcgtggtggctcatgcctgtaatcccagcactttgggaggccgaggcaggtggatctcctgaggtcaggagttcaagatcagcctggtcaacatggtgaaacccggtctctactaaaaaaatacaaaagttagctggacattgtagcaggcacctgtggtcccagctactagggaggctgaggcaggatactcgcttgaacccaggaggcagaggttgcagtgagccgacattgtgccactgcactgcagcctgggagacagagtgagactccttctcaaaaaataaaataaaataaaaatgtacatatatataatttgtagaaaatgtgaaggatcacaagaaacttgcgagttaggactagggaaggagaggtgcatggggtgacaaagggatcttttctgttttattttttttaatttactgctgtttttcaccataaaactggggggtatattacttttaaatttaaacaactattaatagtaaccttttgttatttattttgtttatttatttatgtatttatttgagacagggtctcgctctattgcccaggctggagtgcggtggcactatctcagctcactgcaacctctgcctgctgggttcaagcaattttcgtgcctcattctcccaggtagctgagattacagatgtgggccaccacaccaggctaatttttgtatttttactagagacggggtttcactgtattggccaggcaggtctcgaactcccgacctcaggcgatccacccagcccggcctcccaaaatgctaggattacaagcgtgagccaccgcacccagcctattttttatattttaataaaaggtaactattagggccaggcacggtggttcatgcctgtaatcccagcactttgagaggccaaggcaggtggatcacctgagatcgggagtttgacaccagcctggccaacacagtgaaaccccttctctactaaaaataaaaaaattagatggctgttgtggcgggcacctgtagtcgcagctacttgggaggctgaggcaggagaattgcttgaactagggaagcggaggttgcagtgagccaagattatgccactgcacttcagcctgagtgatagagcaagactcagtctcaaaaaaataaaataaaataaaatattaaaaataaaactacagcttcctagtcccagcccctgacctagtgcctggggtccctgaggcaggcccgggaatctgtacagggtctgcgggtttctccaggtggcatccctcctgtctctaggctctaggatggtctcgtggctgtggcagtggcctcttcatgctccatgcacccccagtaccatattcaccctctctcaacttccatgcttttgtgacgtgtgtctccttcacagccataacctctctttgagagcctaagttagaccttacagccgggcgcagtggctcacgcctgtaatcccagtactttgggaggccgagatgggaggatcacgaggtcgggagatcgagaccatcctggctaacacggtgaaaccccgtctctactaaaaatacaaaatattagctgggcgtggtggtgagcgcctgtagtcccagctactcgggaggctgaggccggagaatgatgtgaacccaggaggcggagcttgcagtgagccgagatggtgccactgcattccagcctgggcgacagagcgagtctcagtctcaaaaacaaaaaacaaaaaaaccttactatggtgatttcttaatttcatttatttatttatttatttacttattttttttttttttggagacggagtcgcgctctgttgcgcaggctagagtgcagtggcacaatctcgactcactgcaacttctgcctcctgggttcaagcaattctcctgcctcagcctctccagtagctgggattacaggcatgtgccatgatgcccagctaatttttgtatctttagtagagacggggtttcgccatgttggccaggctggtctcaaactcctgacctcaggtgatccgcccacgtcagcctcccaaagtgctgggatcacaggtgtgagtcactgtgaagcacccagccaattcgtttcttaaagcccaataaaacttgctgatatggcctacgggaatttcctagaatctgtcatgtgagattctgcttagtgtgcttgcttctgtcacataccagtctcaaccttaaaaaaaaaaattcaactttgattttagattcagggggtgcatgtgcaggtttgtttatatgggtacattgcatgatgctgagatttgaggtccagatgatcccgtcacccaggtagtgcgcgtagtacccaatggggagtttctcagcccttggcccctccctctgtccgccctctggtagtccccagcgtctgttgttccacctttaagtcccatccttctttttgagtgtgagcctcctattcagccactggctcaaggggtgaccttcgccagtgtagggtgctgagctgggtgtgctctgaggtctctgccctgccactaccttacctgacctcaggcaagaccacaaccagaatcttaaagaccctaacctgtggctcttgaaagccaagttgaacactggaatatccagcgacgtttgttaaaaatagattcctgggcccggcgcggtggctcacgcctgtaatcccagcaccttgggaggccgaggggggcagatcacaaggtcaggagatcgagaccattctggctaacatggtgaaaccccgtctctactaaagatacaaaaaattagctgggcgtggtggcgggtgcctgtagttccaggtactcgggaggctgaggcaggagaatggcgtgaacctgagaggtggagcttgcagtgagctgagattgcgccactgcactccaacctgggtgacagagccagactccgtctcaaaaaaaaaaaaaaaaatggattcctgattcctaccccagacccactgagttggtcttaggagaagtgagttaagattttcaaaagttctccaggtgattctgaggctctggcaagtatgtaaaatactgtactgtccaagctcatctaaatagtctgttgcacacacacagagtccatgtttatattctttatctgacattctgccatacacatcagggtgagtaccaatcatggaggtaggagcggcaatgctttgatgaggctgagctccctgctctatattgtacctgtgatatctcagctagaaggcaggtccagtgttagcccagttctaatgccagcatgagatcttgtttggaaatgattttcataactgccacaaatgccttagtgtcctgccaatggcctgggcatctgccatttctgggcacacctgtccaagtggcaactgtccacccctgcacctctgcctgaggggttccctgctggagcccagtctgtctgcacaaggcaggcagaagtgctggggatggagaatcaaaaccacccaggagcagccggcagccagtgactgacctcagctcctggaggggtgggatgacgccaaggtgtgtgccacactgtctccctgcgttgcacagaggactggaccctggttgtccaccgtgtaactggctgggtagcttcccctctactggatcctacccctccctgcctcacatcttcgttgccctataggttcttcccaggatcacctctcaaataaactacttgtactggaatctttgtcccaggctctgtttctgggaatacccaaattaatttttttttaatggagtctcactctgttgcccagactggagtgcagtggctcgatctcagctcgctacaacctccacctcctgggttccagtgattctccttcctcagcctcccgagttgctgggactatgggtgcgcgccaccatgcctggctagttttttgtattttcagtagagacggggtttcaccatgttggccaggctggtctcgaactcctgacctcaagtcatccgcctgcctcggcctcccaaagtgctgggattacaggcgtgagccactgcacctggcccgaattaattttttttaaaagtttactttgctcacaataatatgaaaacattaaggtatgtgagttggaagaataaaaatcttcctccctaaagcaggtggtggttttgtttgtttgtttgtttgtttgttttctatgttggcatctgtttgtgttaggtttactcaggtggatgctatgattttttgtagacagttttctctcctgctgtaaccattgtcctcatgctgccatgaatccttggtcatggcatgacttttactggcttcatagttgggtggttctggcttggccatgaccaaccgatgctgtgtctgtccctcatcctttcaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttgccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgctgtttaagcaaggcaagtgaattttgttattctgaaagagtttacagaaactattttaataaatgaaatgttcttgtgaagcttttaaaagcaaaatggaacattgacctacagctctctgttcagggcttattgtgtgatgtttaacttcaggttattgaggtggggaggttgattactttatattagttgtgtgggtttgaagaagcagatcttcctctctttttttgtttttgagacaagttctcactctgtcacccaggctggagtacagtggcatgatcatggctcactgcaaccttgacctcccaggctcaggtaatcttcccacttcagcctcccgagtagctgggactataggtgtgtgccactatgcccagctaatttttgtattttttgtagagatggggttttgctatgttgtccaggctgagaagcaaatcttgagtgttgggtggaagaacaaacggccaattggaaaaacctgcactgaggggctggctcatgcaggctggtgggcagagatgcctgggggtggcatggcagggaactcaactcatggatctctttttatgggcctggtctctttttctgcagaggtcttggctttctgcggttaggatgcgctggccgaaggctcttctccctcccttgaatgggctctgtggccaaccctggagcatgagaaatgctggctcctcacttgcaggtgggataacagtgacaggagttccctcagggtgtgtgacagctgagtgaagtgacctctgctacctccatctcctcaccttggaggcctgcgtcagagccatgggaggtgagaccctgactgcctcggggggtatttgcctcaggctgggagctgttgcctgaattgagtaggaagttcggatcacctacaccctgatcacctacaccctggtcagcaacagcccatcacctacaccctgatcgtctacaccccatcacctacatcctgatcacctacaccctggttgccaacatcccatcacctacacctcaatcaccttgaccctgatcacctacatcccatcacctacaccctgatcacctataccctggtcacctacaccccgatcacctacaccccaatcacctacaccctgatcacctacaccccaatcaccaacaccccatcacctacacctctatctccttgaccccaatcacctacaccccattgcctacaccccaatcacctataccccatcacctacaccctgatcacctacaccccaatcaccaacaccccatcacctacacctctatcaccttgaccccgatcacctacaccccattgcctacaccccaatcacctataccccatcacctacacctcaatcatctacactccatcacctacacctcatcacctataccctgatcacctacactgcatcacctatacctcatcacttacaccctgatcacctacaccccaatcaccaacaccccatcacctacaccttgatcaccttgacccccatcaccgatacctcaatcatctataccccatcacctacaccccatcacccaaaccccagtcacctacacctgatcatctataccccaccacctataccccttcacttacaccctgctcacctataccccaatcacctacaccctgatcatctataccccatcacctatacccgtcacctacaccccatcacctacaccccaatcatctacaccccaccacctatacctcatcacttacaccccgatcaccaacaccccatcaccaacaccttgatcaccttgacccccatcacctacaccccatcacctacacctcaatcatctataccccatcacctacacctcgatcatctataccccatcacctacacctcaatcatctataccccatcacctacaccttgatcatctataccccatcacctacatctcgatcatctatatcccaatcatctacaccccatcacctacaacctgatcacctataccccgatcacctacaacctgatcatctataccccatcacctatacccatcacctacaccccgatcatctacaccccaccacctataccccatcacttacaccctgatcacctacaccccaatcaccaacaccccatcacctacaccttgatcaccttgacccccatcacctacaccccatcacctacacctcaatcatctataccccatcacctacacctcgatcatctataccccatcacctacacttcaatcatctataccccagtcatctacaccccatcacctacatcctgatcacctataccctgatcatctacaccctatcacctacaccccattgtcttttattgcccactccctgtcccctgggcaccacctgggccacttcttggtctagggaagcatccagatgaggaggcccttgtcttattttctccctccctgcttcctctttcccctccctcctttccttccaccttcttctctccttctctcccacactgtgcgccaggccttgtgccaagatctggacattttaagtggcatatcctatagcttgagtcaatgcttctcttccaattaagcgcttttgtttcagaaggaaaggaaatgaaccctttttgggcagtgagctaggtagtcctagctgggcagatgttttctggaagaatcctcagagcacccctggggtcacaggcctgttttcatgagtagatgaggcaactgcagaggctgtcctctggcggtcagaggcagaggccaggaatcctaagtctagtcagaacacctctattttccccctctctcctcaccttcccttcaaaaaagaaagcaaaggcctcaggctggactgggaccatgcagaggcaggtatgagaccagggctgactggggagtcctcacccctctgctgtttgaactggcaagtttcagggaccctggggccctgctctgcctcatgtgaagctccgggttcctgggctgaggctgtagcactcaacagtctaaatggccccattcaggcagcagcagcagcagtaggggttgaacctggcactcaagtgtcacaggtgcagcctcccaggacagcaagtgctgaggatcaaccctgactccagagggcagagtactcacattgtgttctctcttagcacttgctgccaaggaaggcgccgctggaaggcggttgatttgctttctccttggttatctgggtcatgtagacaacaaaagtgagcgttcttagaaaggaatatccaaacgacaggctggggcagctgacctgtgcctgttttgcacagggaattgtgaaccagctaacgttctccttagggtcaggtttttatttaacagagctcttggttgcaagagacagaaacccagtgtaaaacaacttcagcagaaaagggaatgtagtagctgtaaagcttagggttgttccagtttcaggggtggccagatctggtgcttatgtgatgtcatcctctcttacctccctctccgtcttttagctcgatttcccccatggtggcttctttctcaggcaggcgcaaatggaggctggatggccacccacagctctggacttctgcctcacagtgcagtcactcagcaggagggtttctctttcaggctaagatcttgggcagatttggctctgggacccaccctcaactaatcactgtgccctgggaaatgtgcagctctcttagcccaggcctaaacccctccctcccctgaattgagtggagagagcgcaggtcagctacaccactggtctgggagcagtgggaaagggattctccagcagaatcaggacaacatggccaaaagaagtggacgttgggcggctatgctagttaagacaaggcatggctgggccgggtgcggtggctcacacctgtaatcccagcactttgggaggccaaggtgggaggatcacttgaggtcagggatttgaaaccagcctgaccaacatggtgagccaagatcgcaccactgcactccagcctggcgaaagagcaagactccatctctaaaacaaaacaaaacaaaacaaaagatcaggcgtgctgctgtaacaaagattcccaacacacctatggcttaaagaagagagagcgttgtttctcacgtagtagttctgggttgagagttctcctccatgacatcacttgggggcccagagttttcccttgcgttgctctgccatgccctaggataatgccatcatatgtgtggtagaagctgggtgtctatgggtctcagctgatcagagagttgtcttgaagaagcaaatcttgagcgttgggtggaagaacaaatgactgattggaaaaacctgcactgaggatctggctcatgcaagctggtgggcagagatacctgggggtgacttggcagggagctcaacaacttgggctctttttaaggtcctggtctctctttttttaatatatttttggtttccccagaagccaattccgaggcaaggattaaagttcaagtggggctgggcacggtggctcacgccggtaatcccagcactttgggaggccgaggcgggcagatcacgaggtcaggagtttgagaccagcgtggccaacatggcgaaaccccgtctctactgaaaatacaaaaattagccaggcgtgatggcaggcgcctgtaatcccagctactcaggaggctgaggcaggagaattgcttgaacccaggaagcggaagttgcagtgagccaagatcgtgccattgcactccaacctgggcaacaagagcaatactccatgtcaaaaaaaagaaaaaaaaaaaaagttcaagtggattgtttaggaagcaatcccagaaagtatctgcaggggattggggaggtgtgacaggaagaaaagtgcccatgtggggaacagaatcaaggaagttactgctgtgggtaactggtgcttaatcaccctgggccctctaggaggcagtacagcacacgtctcagagttatcccactgcagatgcataggacactgtctgcaactttccatccatcattggttgaaggctgctgacattagggcccttccaacttgccctgtgcactggccaagcatgcctcctgtgccaggaaaatctgcagaggttagctgtaagcagctttcagcacatagacctgaaagctggcaaaacccagtgagatgatgattgtgtctggtacaggtgtggaagggtcacagcccctacctgaagacactggcctgggtatggcccttccattcccattccatagggagaatttagtcacattaactagaggggtggagaaaagcaggtgtctcagccacaatacttctgtgcagcagaatggggatggattatggtggatgactgaaagtctctaccatggcaggcaaagtcaactgatgtccactctagccttttttgcttcctcctcccaactctgtttacctgtcctgctctcagccagttgctaggaaatccagccaaagtgcccaaaatcatgacttagggttctcaggctggcagccctggagccttgggtctgaaggtgttggggatggagacccatgagctattaacttgtaccgagtccacccagcactatctgctttgggttggtgttagtttagcaccatgtggatatgctgatgcttgtgctagtcacaagtgcctactggttattcattttggagaatgggatctgttttccatcaatgtgatttattttgtgaatgtcttaagttgggtcctagaagcggagtctgagacaaggattctggggtaagtgatttattgagggaggctctcaggagaaaccaagaaggaggtgagggaagcgagggaagtacagcagaggaataaactcagcaaagatgcggggtcggctgatgtccagcctcggcctgattccaggcagctctggatatgaatggcaccaccgaagttgtcccaccttgaggcaagggggcctgtcatcagctgtgggctacccctggtcaggcaaggcataaccaccgggcattttcagcaatagcaactgtgagctgtttagtagtcaatgctctgagcagctgcaggctggctctctaaaggtctccaagcagaggaagagaaatcatagcgacggattcttaagggtgaaaaagacggcggtccacagaatctggctacatccctctggaacatttgcattttgataaaggacttgcttttggagctaaggagtgaatcatttattgcaaattatgtggcattttcagaagaagtaaaataatatatagaaatgtacacaaaggaaagtcatatctgcaaacgagtcccttatctgccaagcctctcctctaccattgtaattaaccactgttattagctcctcctgtaactttcctgagtttctttacccatatataagcaaacatgaatgtgtgtattcttgctgtccactgtttcttcttcttttagcattttaattagcagatagcatattatacatactgtttggaactttgcatttttcttttttttaattttaaattttaagtgttgtgggtacatagtaggtgtatatgcatttttcttttaatagtacatctagtggttctttccaaaatagtacaaaaaagtgttctcatacaaaaaaattagccgggcatggtggtgtgtacctgtaatcccagctacttgggaggctgaggcaagagaatcgcttgaaactgggaggcaggggttggagtgagccaagactgtgacactgcactccagcctgggcaacagagtggactccatcgcaaaaaaaaaaaaaaaagtgttttcatt

SEQ ID NO: 37556 - DNA, 180263 bp, Homo sapiens; identical to SEQ ID NO: 35768

SEQ ID NO: 37557 - DNA, 99176 bp, Homo sapiens; identical to SEQ ID NO: 37335

SEQ ID NO: 37558 - DNA, 79911 bp, Homo sapiens; identical to SEQ ID NO: 37501

SEQ ID NO: 37559 - DNA, 6009 bp, Homo sapiens
ggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagtaagtatgcgtctgagaggtgatccagctggaaaggaggataagttctgtctgtacagtgtgggcatttctctctctcacacacctccatttcctcaaactttccttctctaggctgctggatgtcattcacacagaaaataaactctacctggtttttgaatttctgcaccaagatctcaagaaattcatggatgcctctgctctcactggcattcctcttcccctcatcaaggtaatgcttctcatcagctcctctcatcatgggcatgtcttgggggactggtggcaggcaattcagggtgatattttatgattttggcctccttctgagccctcatctcctatacacacacactccccttctttttgtgtctccttccctgctcattatattcattaaccctagggttggactgaacaatcaaagttgaaactctagtgagtcaacctagcaactcaggtgggaggtcagatgaaactcagataaacgggatttgagagcacttggtaaattcctccaaaaagcccttccatttggtggaagacctagctagtgagtccctattgtctattttagggctggattcttcactcccagagctactttcaatctattaacaaacattttttcaatgcacaggatgtagaaaagggatggaaaattgagtaagacttggtccttatcctctctgggctgacagtccattgggagaaatagcttgtaaatatgtaactataatccaacataataaaggctttagtagagttttaggggcacagagcaaacccagtctgctcactgtaatggagaaacacagtcctctctttctcctttgtcagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgagtccctttatgtcttttttctctgagcttcccaagaggtgttaactagggtattcacaaagttactaaaaatatctggctaacagtttcttactaggtagaaataatctcttgacatcctaaagagtcttagggtatgcatggaattcatactgtgttgctaactgggcccacacctgtaataccaatactttgggaggctgaggtgggaggatcacttgagcccaggagttcgagaccatcatgggcaacatagcgagaccccatctctacaaatctacaaaaagaaaaaatttagaaataaaattatgaccaatttgtctcaagtttttccaggaagatctcaaattaggggttcagtccagaactatggactggaaatcagtgggaggggaaagatgatggagggaaggaaactgcttgttaagaggccaagagtaagcagagtagtgttgaggaactgagatgcgggaatttccataccctataaaccaccccgcccctccctattcccgtccctcaggtggtgaccctgtggtaccgagctcctgaaatcctcctgggctgcaaatattattccacagctgtggacatctggagcctgggctgcatctttgctgagatggtatggaggcttgcccaagttccacccagccccctccctctcctccccacatccaagaacaacagaactgcttcttggcccagacctatggcccttctatcacagggttctctctctaaagtagcaccaaggggaatggtgggaaaggatgcaactgttgccctgatatcaaccacagtgttaggatatcctcaaacagccttagtacctggtatacatctcttatccctgaaataagttaaagcatttctgcagctgttttagctgtagtctgcatatatttgggagaatgattccatttagtgcctcttttatttcaggccttcatttcaaggcttgtagaccttgttgtatggtgccagcaatgtagtgaagacaactgtggtcactttacccacacctttcatttaaactgcagatttaggcagggtgcagtggctcacacctataataccagcactttgggaggctgaggtaggtggatcacctgaggtcaggagtttgagaccagcctggccaacatgttaaaaccctgtctctactaaaaatacaaaaattagccaggtgtggctacttgggattacacacctgtaatcccagctacttgggaggccaaggcaggagaatcggttgaacccgggagatggaggttgcagtgaccaagattgcaccactgcactccagcctgggcgacagaatgagattccatctcaaaaaaaaaaaaaaaaaaaaaaaaaaaaagatttagatcatgttccccttcaacctctggcttttcagactgaaggatccttgaagcctggctttatgtagaagctcccatctcctttaatataacagtacagtggtgcagtaggctgtcttcaaatcagcaatatgttttattgtcttttatcttggttgtaaccaagagcttaaagaccattagcctatacatatgtaatgtgcatttatccccccagtgcattaccttacaattgtccgtattcctctctcaattcatcaaaaaatatttgttaagcacctagtgggtacccagcaccatgctaggtgctgtggggaacacagaagaaatggaagacagagtctctgcccgctgtgctcgtatctagaagtggctgcatcacaaggttgggggatgaccgcagtgtctaccccctaccccgtgagtggcttgggatacctttgctacatgtcagtggcaccccagacattcaccccctcccagacccacccagccttggggatctgcaaagccatggttgggggaaggaaggagggggcgaggagacagatgaaggaacttcattgtctcaggttctgtgtgactgaccccatgaaaggccctggggagggagtcatggggccctgctgaccttttactgtctgtgggaactcctttgtatagaggagagttttgactgacgtcaacgtgggtcttggtatttcctctttccccattttcaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcggtgagagtgggcacctgttttccctcattcatttctcccagggaagggcttttccaggatgaaggaaggatgagaccctgaaatctgggcctcagtgtttcatttccctggttcctgctctccctgttggcacactgattcagctatgggaggatggaagtgagaattctgccttgggtagaaggagttctggtttcctgatttctgggaacacctgctgcccatttagtccactatcacatcattgaagtcaacatgcatctctccctctagcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttat

SEQ ID NO: 37560 - DNA, 157260 bp, Homo sapiens; identical to SEQ ID NO: 36996

SEQ ID NO: 37561 - DNA, 37771 bp, Homo sapiens; identical to SEQ ID NO: 36007

SEQ ID NO: 37562 - DNA, 136264 bp, Homo sapiens
aagagcaacacagagctgaaaggaagactcagaggagagagataagtaaggaaagtagtgatggctctcatcccagacttggccatggaaacctggcttctcctggctgtcagcctggtgctcctctatctgtgagtaactgtccaggctcctcttctctgtttccttggacttggggtgctaatcaggcctctctttcccttatctgttttgaagatcaaaaaagatgttcaggccgggcgtggtggcttacacctgtaatcccagcactttgggaggctaaggcaagtggactgcctgaggtcaggagttcaagaccagcctggctaacatggtgaaactctgtctctactaaaaatacaaaaattagctgggcatggtggtgcacgcctgtattcccagctacttgggaggctgaggcaggagaattgcttgaacccggcaggcggaggttgcagtgagctgagatcatgccagtgcacttcagcctgggtgacagagtgaggctgtctcaaaaaaaaaaaaaaaaaaaaaagatgttcaaggagcagtagcttaagtgttggatgctacaaacatatagaggttattgtagatcttatgcagctctataaaggaataaataagcatcttccccatccatctttagtggcaagaagggttttgggatagcattgattgaggatgatctacttgacaatagtttggacccaaggaggataaggaaggaaagtagtgacggatctcattccaaacttggctgtggaaacctggcttctccttactaaactagaatttggattttacattttcccctttatgttgcagtagaagaggatgaatcctctcactggtgggatcctgccatcctagagcaggtagagagaagagtcactccccactgtgggtagtggaggcttctcacatgtcacatttcacttctacctcaatttcactcttactaagatttgggaatcataatgacaggaaaatagaaaatataaacctcattttaattctttcacagaaaggttagaaattcagtgagttgtggcaacatattttccatcttctgaccttttaacactaattgatatggcttaaattcattctattttaaaccagatttttttggagatagtctatttccaacatgttccttctaggtgacaaatgagggctgttagttcagtatttgttacaataaatgtgtgtaaaataacctcacctttccagaatcatgtcaggaatatgaatctaatgcacaaatgtataactctatgacaagattgcatatatcttttaaaatataccttcccaacgttcattttaatacccctatttcaaacaaacctgcttagcaggttatgttaaacgctcagggcagaggagtaagcaagactgtgagccagtgatgacagcaaaagcatccaggtaggatcaaaatggagtaagaaaatattcctcatccctcagggtagaactccaaagagatattcatgggtcctggccccgtagtggaggtcactcaaaggacaaacatgtttgcatctcatctgcttgaagcctggacacagaggcaccatctgtgtcactctgtgtgtggtctgccatgttgtggggtggtcactacagactcaggcagctgggcagacaataccttagccttagatgatgctgatgcagcccaggagtcagaaactgtagtgcagacaatgccctccttaggccaacacaattaagtgcaatagatgactggcttttctgttagcctcttcattggaaccaaaagcagcattactctaccaaacagaggggagctggaaagaaactacacagtttgcccagcctagcctctgccttgacacggaaccatgtgagtctagacattcacctagatcattccttggggaccaatgctgctgacacattaactcaatagtttgtcctggcctgagaggtcatgtaacttgtagaaagtttagaagcagagattagtgtcatttatttgccatggctgtgacaacaaaggaaggaacaggagtgggaaaacccaaggccaccctggttttggtagatggtgcacacgcttccactaactgttctggggcaaagatccaaatgcactattgggcctggctatgctgcttctgctgggtcccccaaacatgagcctccacgccatttctcagttgtattttaccacatattatcacagtcaccggatttgtacagaatatttggaacctatactgtcttaagggctaccctttaaagaagagaaaacaaggttttaattcaactgtctggaacattttatgtttacttatgtggaatactacatcttttgttataaacaggagggaatgtggacattcgaaggcccctaccttttagctaaaagcccatatgaagcatatggatccatttatacacaccatgcttttcagctacattttcctaatttgcctctctggggccaaccttgtgggactagcagattcatggttgagttgaaggatggtgacctcttccatcagcttttcttcttcctccagtcttccaaccctcagtaacatcagactgggaaggtcttcagacatccagaaaccccagttcggggagttcatacatgacccatcaaagatgagttgcaagcaggcctgccttagggagcaccagccttaatgggttttcctacagagatagttgatgggcagatgcaataaactgactgctttgtgattgaccaccttgagaaaaattagcatgtctggctatgttagtcttttcttgcattgttataaagaaataccagagtctgggtatttataaagaaaagggatttaattgtctcatggttctgcaggctgtacagaaagcatagtgacttcttcctctagggaggtctcaggaaatttacaatcatggcagaaggtgaaggagaagcagacagatcttacatggctggagcagaagcaagagaggctggggagaaggtgccacacattcaaaccaccagatctcataaaaactcattgtcacgaggacaacacctaaggcgggatggtgtgaaacgatgagaaactgcccctaggatccaatcatctcctaccaggccccacctccagtattggggattgcatttcaacatgagattttggtaggggcacagattcagaccatatcactggcactgtgctaatcagatgaatatcaccagttggaaggctagattccacaagaggaggaatgacctggaaattggttctttagttgtgattcttctgcacactgtcattcagggaaatatgagtcaatcatccttcccaataggtcaaatcaaccagatcatctgatcacagagactgaggtgtagctgaaagctgctcacatttctatgaggtcaatggaagccttgagcacagttgtcaatctgtagaaataaggactctgtgactcctccaagacctctctgtgaatgacggtttaagaagaaccagatcctaaaacagggtcagagcttagagggaagggaaagcataaaagcctctgagcaaattctaaagacagggtcaccataggctctcagtgaccctctgtgactgagtggctgcagtgatgcaaaatctcatcatcactgcggaagacaaaaaaatgtcaccctttctacctaggatgagaatccccaaatttggggagaggccacttactaaatagacgtaaaggaacaaagtgacctggaagaattcctgcctgaacctctcaggatcattcacatttgagaacatttatcaaatattcattccaggactgggaccatgaagacttcagctgctttgagctaatcattgtaactttttggtgtctcatggtggaggcaggaaaggacctgatgaacaaatataatcattgccgtcagagttactgttattatttcttgccttaatgttacctcgttctcttgagcattccagttcctcagtcaatgactcatcaacccctatatctataaagtcacaatcgctgtgacttgatttctgtttcactttgtagatatggaacccattcacatggactttttaagaagcttggaattccagggcccacacctctgccttttttgggaaatattttgtcctaccataaggtgagtgtttttgagctcactcttttgcttcttatgattgccaagagcagcttagttccatcagtaaaaatgcttctcctcagggggaaggtctgaagttttacactttcagaaacagtgtgtaggcatcacccagaacatggcaatgtttacccaagggctctcttgctaactctcaggaacctcaggtttgcctcagttgaacagcccaaatctcaggtagatcagcaacctgatgctcagaacttgatgtgcaaactttgtgagcgccataaagaaggttttctttttgctctatgcaggttcccaggaaggtacagtcatacttagttagtattaaaagtaggaaaaggaccccctgattgtgacttgttatctgtgtacatgagagtcaaactttcctctctgtagcaagagctcttgagtagccttttttcccttccttctggacagctttgaaactcaatttattagggagcccaggtatttacctttgggtcatttgcacctgcttcaatcctctccgaaaaatgctaaattccctgagggtatctccatggctctaccccagctcttactccccatgacatcttttgcagctttgagagacagaacaaaggggttctgctttatttcttttccttcaaaggctgcaccttatgggtgagtctgatcacagactggatataactgagatgagacagtggtggtcaatcaaactcagatatttaagcacaaaatgagtttgtggggttttttttttacacaaaggcggaatcacatgcaaaatcactagaaaggggatgatttgatgaaattattaaatatttaattttgctgaatagaatataatatgtgccacgtggaccgtgaactttggccgagcctttgtgcctaacctagtctgatgctctgcccagggtctgggccctggatggaaaattaggagcccatgtccacatggccagccgcagcagtcagctctttggcttacatcatctttcccacatacctgaggcttgtttctcagattctaattctctcaggtgagggctttgttgtctaattactatccaggaatttcatattttttccctgtgcaaaagcaataatttccccgccaccttttccaggtcaactctttagtagatgtacccccaagatgcacattcctgggacctttgtttgcacagttaaaatgtcacccctgaaatgtcgatacaggaaggtttgtttttaagtttcagtgaaaactctgagcaagtgttgtaatttgctgtgtccgatgtgtagaggggacattttctcagaacttccatgttaagctggaaaactggaaagtgagttcactttgtcattctgtcactcgttcattttctcactcaacaacatgcctcatacttacctaaatctgctagactaaaggagttccctggtgtctgtaactttccaattctgctagaactctagagcgagctcatgaaataaatgaaaaggatgacaaagagataaaacactgtgcattctcttctgatgctaattcactttcccttggcctcagtttccccatgtgcccctggaggtgatcattcagggattcatgagattttcaagacaacacatgaaaaagcaaaaagacatcagaaagacaaagaggtacttagtatttatacacaaggataagtcattcagtatccacaacacttggagagaattcaagagtgattttaaatttcccttttcaaatacctcctctgttttctcttatttcctttatgacgtctccaaataagcttcctctaactgccagcaagtctgatttcattggcttcgactgttttcatcccaattagaggcagggttaagtacattaaaaataataatcaaatattattttgtttctcctcccagggcttttgtatgtttgacatggaatgtcataaaaagtatggaaaagtgtgggggtgagtattctggaaacttccattggatagacttgtttctatgatgagtttaccccactgcacagaggacagtctcagcccaaagcctcttgggatgaagctcttgtcaacctaactacaaacagagagaagttctctgaaagaagaagatatttatttgggtgtagagtattgcaatgggaatctgcatgcctttataaactatgtgcaaattcagggaagtaaagcaagacaaagaggctccaaggaaaatatgaggaggatttcttatcagttttgaaataattatccttcgctacaaagatcagtaacaagggtgacgcctcaccaaggttggacaggcagttgctgggcaggtgtccttgcagaaatattttttttaatgttgggatggcctttgtgcaagcttgtagttttgcggagtcttttgtgatagttttgttatcaggcacacaagcatgagaatcctctcttcatagccttctttgatttatttgtcagggtttttacacacacacacacacacacacacacacacacacacacacacaactagtgacatcattttggttctaacaacattcacactggttattgtaaaacttttcgaaggttgtcctaccaaggatcccatgtgtcaccaggtgtcaagttctacagtctgaactaggctgggagcattgtgattacttttctccagactttggtggcccagggactcacagcatcatgctctgtccagtgtctgcctattcccctcttctttttttttttccttaggtgcccttttattacatgtgttgtctcagacccttctaatatgtgctcataaatacatcatatcatctccttcccacatcaattcactttcaattaaaagccaaaactctttcatttagactttggatttaaagtgcttttgaatgaagggttgagagataatagagaaatagattggcaaaccatttatactctgctgttgttgttttttaattttatctgcaagtgtggaacttttcattctgttttgttattaaatttaagccaagactttttaatagaagggtatataagcatttctttgtctataccttcctgctgaatttgaagaaatgctgaatattcttaaccactggcgggctgatggactgtgattttattttattttttatttttagttttttaaattatactttaagttctgggttacatgcatagaatgtgtagttttgttacataggtatacacgtgccatggtggtttgctgcacccatcaacctgtcacctacattaggtatttctcctaatgctatctctcccctagccccccacccaacaacaggccccagtgtgtgatgtttccctccccgtgtccatgtgttctcattgttcaactcctacttaggagtgagaacatgtggtgttgagttttctgatcttgtgatagtttgctgagaatgatggtttccagcttcatccttgtccctgcaaaggacatgaactcattgtttttttatggctgcatagtattccatggggtatacgtggcacattttctttatccagtctgtcactgatggacatttgggttggttccaagtctttggtattgtgaatagttctgcaataaacatatgtgtgcatgtgtctttatcatagaatgatttatgctttgggtatatgcccagtaatgggattgctgggtcaaatggtatttctagttctagatccttgaggaatcaccacactgtcttccacaatggttgaactaatttacactcccaccaacagtgtaaaagtgttcctatttctccacatcctctccagcatctgttgtttcctgactttttaatgatcaccatactacctggcatgagatggtatctcattgtggttttgatttgcatttctctaatgaccagtgatgatgagcattttttcacatgtctgttggctgcatagatgtcttcttttgagaagtgtctgttcatatcctttgcccattttttgatggggttgtttgctttttttcttgtaaatttgtttaagttctttgtagattctggatgttagcccttcgtcagatggatagattgcaaaaattttctcccattctgtaggttgcctgtttgctctgatgatagtttcttttgctgtgtagaagctctttagtttaatcatatcccatttgtcaattttggcttttgttgccattgcttttggtgttatatttatgaagcctttgcccatgcctgtgtcctgaatggtattgcccaggttttcttctaggatttttatggtcctaggtcttacatttaagtctttaatccatcttgagttaatttttgtataaggtgtaaggaaggggtccagtttcaattttctgcatatggctaggcagtttcaccaacaccatttattaaataggaaatcttttccccattgcttttgtgtgtcaggtttgtcaaacatcagatggtagtagatgcatggtgttatttctgaggcctctgttctgttccattgatctatatttctgttttggtacctgtaccatgctgttttggttactgtagccttttagtataatttgaagtcaggtagcgtgatgcctccagttttgttctttttgcttaggattgtcttgtctatgtgggctcttttttggttccatatgaactttaaagtagttttttccaattctatgaggaaagtcagtggtagcttgatggaaatagcattgaatctataaattaccttgggcagtatggccattttcatgatatggagtcttcctacccatgagcatggaatgttcttccatttgtttgtgtcctcttttatttcattgagcagcggtttgtagttctccttgaagaggagaacttcacatcccttgtaagctggattcctagatattttattctctttgtagtaattgtgaatgggagttcactcatgatttggctctctgtttgtctattattggtgtgtaggaatgcttgtgatttttgtaaattgattttgtatcctgagactttcctgaagttgcttatcagcttaaggagttttggggctgagacgatggggtttcctaaatatacaatcatgtcatctgcaaacagagacaatttgacttcctcttttcctaattgaatatccatttctttctcttgcctgattgccctattcagaacttccgacactatgttgaataggagtggtgagagaggacatccttgtcttgtgccggttttcaaagggaatgcttctagtttttgcccattcagtatgatattggctgtgggtttgtcataaatagctcttactattttgagatacgttccattgatacctagtttattcagagtttttagcatgaaaggctgttgaattttgtcaaaggccttttctgcatctattgaggtaattatgtggtttttgtcattggttctgtttatgtgatggattacatttattgatttggtattttgaacccagccttgcatcccagggatgacgctgacttgatcctggtggataagctttttgatgttttgctggatttgatttgccagtattttattgaggattttcgcatcgatattctttagggatattggactaaaattctctttttttgttgtgtctctgtcaggctttggtatcaggagatactggcctcataaaatgagttagggaggattccctccttttctattgttcagaaaaatttcagaaggaatgataacagctcctctttgtatctctggtagaattcagctgtgaatccatttggtcctggactttttttggttggtagcctattaataattgcctcaattcaaaacctattattggtctattcagagattcaacttcttcctggtttagtcttgggagggggcatgtgtccaggaatttatctatttcttctagattttctagtttatttgcatagaggtgtttatagtattctctgatggtaatttgcatttctgtgggatcagtggtgatatcctttttatcattatttattgcatctatttgattcttcttttttctttattagtcttgctagcagtctatctattttgttgacctttttcaaaaaaccagctcctggattcactgattttttgaagggtttgttgtgtctctatctccttctgttctgctctgatcttagttatttcttgtctcctgctagcttttgaatttgtttactcttgcttctctagttctgttaattgtgatgttactgtgtcaattttagatctttcctgctttctctagtgggcatttaatgctataaatttccctctacacactgctttaaatgtgtcccagagattctggtacattgtgcctttgttctcattggtttcatagaacatctttatttctgccttcacttccttatttacccagtagtcattcaggagcaagttgttcagtttccatgtagttgtgtgattttgagtcactttcttaatcatgagttgtaatttgatttcactgtggtctgagagacagtttgttgtgatttcttttcttttacatttgctgaggagtatattacttccaattatgtggtcaattttagaataagtgcgatgtggtgctgagaagaatgtatattctgttaatttggggtggagatttctgtagatgtctattaggtcctcttggtccagagctgagttcaagttctgaatatccttgttaattttctgtcttgttgatctgtctaatattgacagtggggtgttaaaatctcccattattattgtgtggaaatcttagtctctttgtaggtctctaagaacttgctttatgaatctgggtgctcctgtatttgggtgcatatatatttaggatatttagctcttcctgttgtattgatcccatcaccattatgtaatgcccatctttgtctcttttgatctttgttggtttaatattctttttaaaataaaatattttaaacatatgaaacattatggagaatggcatgggaaatatccacgtatgcaccacccagcttaacaaatgctctactgtcatttctaaccatggtctctttgaagagctcttttgtctttcaatgtctcttccttgtttggcccacattatccttcatcatatgaagacttgagtggctcctgtgtcagactcttgctgtgtgtcatacctaatgaactagaacctaagattactgtgtattgtacaactaagggattatgtaaagtcaggatcaaagtctggcttcctgggttgggctccagctgtagaataaggctgttgatgtttaatcaactctgtttttttcacacagcttttatgatggtcaacagcctgtgctggctatcacagatcctgacatgatcaaaacagtgctagtgaaagaatgttattctgtcttcacaaaccggagggtaagcattcatgtgttgaaattaaaatactgattgattaaatttatattttgaaattcttatatattcatagacagttgcctaaaaaatgtccaggaaggttccacgtccacttcatcctgtcccccccgaatggtaacatcttgcaatcttgcataactataaatacagtatattcatgttactatatagtacaggaaattgacattgatacagttcacagagcttattcagatttcaccagctttatgtgccctcatttctgttctatgcaaatttatcacaatcatagatttgtgcaatgaccagcatgatcaaaacgcagaacccatttgtgttctatacaaatttatcacatcattagtagatttgtgcaatgaccagcatgatcaagatgcagatccactctgtctccatgtggctccctcctgctatcctacagtcacaagtctttttctctgacagggtccatatcagagcaaactattttttattttgaggtgatcaatgtattaatatttccttttctggattgtacttttggtgccatgtttgaaagttctttgcctagccctccttcctatattgctgtttttttctaaaagtcataaagtttaatgctttactaaatgtagctctattatcaattttgtgttattttttgtataaggtatgagatttagatcaaggttcattttttttgtggcttatggctgtccaattcctccaacgccatttttggaaagatgggtatattgttaaaaatcaactgggcatacttctttgcatctctcacgtactactgtgtcccattgatcactgtgtttattattccaccaataccacactgtgttgaccctagtagctgtacactaactcttaacctcgtgtagagtgattcttcccacttttattgacttattttttcagatttgttttaactcttcctggtcctctgcttttccataaaaattcagaatgagtttctcagtgtctacaaataaacgtgctgttattttgacaagaattgaattaaatatatagaccagtttatggaaaatgtgtatctttactgtttgatctttcaattcatgaacatagtatgcctctccatttccttagattttctttgattgcttttaacatcttgtagttttcagcatagagatcctgtacatgttttgttagatttacagctaaattatttcatttttgttggaatgactgtaaatgatattatgtttttcttgtattttcagatattgattgttgttacatagaaatgtgctttgattttgtgtgttgatctggtatcctagaaccttgcagaactgacatagtagttctagaagtctctttgtatatgccttgagattttacacattgtcagttatgtcacttgaaaatagagacaattcttttatttcctttccaatctgtatgccttttatttcttttcttttgtctattgcactaggacttcccagtataatgttgagtaaatgtggtgaatttttgaattgttcctaatcttaggagggaagccttcagttctttcatcattaagcatcatttagatgaagtgggctgtttttttgtagattctctttatcaaattgaggaattttctctccctagtttgctgagtttttatcataaatgaatgctggaagtactcattataaaaaaaatggctatggaagatgaaagaaagtttcaagcatgttggcttgataggccagttccaagttggcaaaaataattatctcttttttctttctatccatgaaataaaaaattaagagacaagaatgtttatggaattgcattatttcttcaaaatatgttcctagttttaaaggtattacctactattttttttaaaaccatcacattgaggcacttctttttcacgttgcccatgctgcaggagaacataaagacagcttgtctgaggcaacatacaatccaccaaagtcacctgcttgtctgtctccactccgtctctacactgcagaagtgctaggtcttgattctgtttattgtactggaagaacacattctctaccacgtggataatttgcatgtaaaagaagactgggatatagaggctggagacgacatcagggtctcctgaacactgccgccacccccccgccccgccccacacaaatacatcccaggacactgggcatctgggataaatctctattgagcatctagcatagggcccatcacccagtagacagtcactaaatagttgttgaataagtgttcctgtttaacacattttctacaaccatggagacctccacaactgatgtaggacaaaatgtttctgctttgaactctagccttttggtccagtgggatttatgaaaagtgccatctctatagctgaggatgaagaatggaagagattacgatcattgctgtctccaaccttcaccagtggaaaactcaaggaggtatgaaaataacatgagttttaataagaaacttaaagaatgaatctggtggggacaggtataaaataagatcacagtccctttccaaggggtagtccactgaatttgagctgcctaaaaatggtcttttatctttatgtacagaaaacacatcacaaaattcattataaaatgtcacttactgctccatgctggggaaagccatgtccttctgggactagagtctgcacatttaactatgggtggtgttgtgttttgtgcttagatggtccctatcattgcccagtatggagatgtgttggtgagaaatctgaggcgggaagcagagacaggcaagcctgtcaccttgaaagagtaagtagaagcgcagccatggggttctgagctgtcatgaacccctccagctgcctgccatggagctgatattcctgctgttgggttattccagtgaccagacaaaaggagggctgtggtaatgcaacttcaatgggtctcccaagatggggcagctccgatgaggaggtggggcagctggaggaaaaggatcttctcccctgtgcacaggggccagggtttacatatccattaaattgtcaccttggatattctagaagactaaatatatcctttagggggaaaaagtgtgattgtaccaaagttttaagcatggagtgtatgggatggtggaaggggaaggcacttggtatctgttggttggcagtgagtaggttgggagagttataatggagaacttagaataactttgatcatttcatgtttttttctgaggatatcagtagaatactaaatattaaaattcctaccatttctttttcctccagtctcaaagagagagggtggtaaaaacactataggtagggcaagcctattatttgctatctacacttatgcagtaaaaacaggtgtaatctgagtttgtcctgggcagaccagggatatgtggtcactcactatagaaatttccaaatcaaattttgagagatttttttttaaccaggacattattggtcattatattttacaaaaataattctgctgtcagggcaacctcagctcaccacagctggggatagtggaattttccaaagcttgagcagggagtatagagaataaggatgatatttctaggagctcagaacagggtactgttgctttgtaaagtgctgaagaggaatcggctctgggcatagagtctgcagtcaggcaatatcacctgtcttgagccccttaggaagagttaattattctactcttgttctgctgaagcacagtgcttacccatcttgtatcatccacaatcaatacatgctactgtagttgtctgatagtgggtctctgtcttcctatgatgggctccttgatctcagaggtaggtctaattcagttcagtgtctccatcacacccagcgtagggccagctgcatcactggcacctgataacaccttctgatggagtgtgatagaaggtgatctagtagatctgaaagtctgtggctgtttgtctgtcttgactggacatgtgggtttcctgttgcatgcatagaggaaggatggtaaaaaggtgctgattttaattttccacatctttctccactcagcgtctttggggcctacagcatggatgtgatcactagcacatcatttggagtgaacatcgactctctcaacaatccacaagacccctttgtggaaaacaccaagaagcttttaagatttgattttttggatccattctttctctcaataagtatgtggactactatttccttttatttatcttgctctcttaaaaataactgctttattgagatataaatcaccatgtaattcatccacttaaaatatacagttcagtgatttgtagtacatttgaagatatgtgtgaccatcatcattttaaactttaaaactttttttgtcaatctagagacctcatacatttttagctatcagccccctgtcacaaaccctgtcatcatatgcaaccactaatcaactttctgcttctatggatttgcctattctggacacttcatagaaatgatattaattcatcagggttttttattctctagttcatgaatttgtactttagtctgtatcattttctttcttctgctggcttcaggcttagtttgcccttcttcgtttactatgttgtggcatgaacatagattactgatttgtgatttttttgttcctctaaatttagacattacagctgtaactttccctctgagcacttcctttgctaaatcccatgagattgtggtctatcacatcttagtttttgttcacctcaaaacagtttctatttgcccttttggtttctactttgactcattggttacttaaatgtttattatttaacttccacatatgtgtgagtttctcaattttctttcccttattgattttatctttattccatgataggtgacagagatatgctgtgttatttctatcttgactacctactatttcttgaacagcaagattaattttgagcttcagattatgatttgggttattctaggagactgtagtccaatagataaaggcaaagagattagggcattgaattttgttccttttatccttcaaaagatgcacaaggggctgctgatctcactgctgtagcggtgctccttatgcatagacctgcccttgctcagccactggcctgaaagaggggcaaaagtcatagaaggaatggcttccagttgagaaccttgatgtcttttactcttctggttggtagagaaaactagaattgctccaggtaaattttgcacattcacaatgaatttctttttctgtttttgttttgtttttcctacagcagtctttccattcctcatcccaattcttgaagtattaaatatctgtgtgtttccaagagaagttacaaattttttaagaaaatctgtaaaaaggatgaaagaaagtcgcctcgaagatacacaaaaggtaaaatgtggtggtagttataggaggatgtttagtttttcataattttttagataatatacatatgatcagtgcagttacctgtatgtttttaaagaatgcttttaacatgaagactgctcatgtttagagcaagagaattcatttggtagaaatgcagaaagtggggtttggggaaggagatatgagaatgagtcagagacagcacatgaaatttgatatcagacacaacaattagtatgccacggcataaattttattgagataaaactttaccactttacttcccttcaataaattgtcagaggataaacattactgtttggaaatatattttactgatattatgctttccccagatcataaattggtaaagactcatttcaagtacaaacctgttattttacacattctcaaatgaaagtccctatcaggccacctgctgaagtgtagcgtgtgttaaatttgagccatctcacatgatagccagatttgtttcaggaaaacatcctgctttccaaggatttagaagggtatgtttttcactggtgattcaggcaacatgcatcagatttctggtcttcaaggagccatattctcagaagggagatcaaggaccacgcttgtgatttacttctgacttcaggagccactttctgtcagtgaaatttctctttttgcttctagcaccgagtggatttccttcagctgatgattgactctcagaattcaaaagaaactgagtcccacaaaggtaaccagagtgtttctgagggctacttgtggggcactcagagggaaggccttgttctgaaaatgtgcaggaagtattccaggatgatgagaatttctgccacatagcagaacgacacatgtttgaatgttataagtggtagttggaggcactttctagaggcatgcaggcatagatagccatgttctaagagtaaagggcaaccctaagcaaacctggcatgctagaaagtcagtctgcggtctgtggatcacctacatcagatcaaatgccaattctcagcctccttcagatccactgaataaaaatttctgcctagaaatttattaggttgctgcaaaattaattgtgggtttttccattacttttaattgcaaaaaaatgcaattaaaagtaatggcaaaaaccacaataacttttgcagctacctaatacatctaacatccaatcaggagccacgctgttccaaaaggggtgattttaactggcagtacttgttgaaagtgtgttcaccaggttaatctactgcaaagttattttccactttggaatggattagtaacttgtggggaaaacctctgagaccgtgtaaatatcctctttgtcttcaatgtttcacctacgagttttacaacccatgtatgttttttactgaagtcactattactatgacagtggcaaaatgatgaccatggtcaattacaagccaccaagacttggcaaccatctcacaaaattcctgaatatttaactattggttctagagagcaggactgggcttactccagcatactgctttaaatatatccatgtctacatccacttttgtctgtatgtctatgtatctatctatgtatctatctagctatgtatctatctatctatctatcatctatctatctatcatctatccatctatcatctatcatttatccatctatcatctatctacttatatattatctatctatcatctaactattcatctatctatcccaatataacttgctgtgataaaggaaatagtctattgttttactgtttcatatagaaatcactagacacatatggctattgagcactggatatgtggctagtgccattgaagatcaattttaaatggtatttcagtttaatttaataaaatttgattttaaatagccactagtgggtagtggctaccatattggacagcagagctctaaactttgagattatagttcaatttcacatcagtatcatcaggttcatgataactgaatactatgattaggtagttgaatttacttataactgcatcacagaagtcttcactggtaaatcacagctctgtcgacctttctcacactcctttcatattggttttggttgtgaattacatggttggagcaggcattatatttatttctatgttccaggtctctaaaggtcctaatccagtcctgatcaaacagaccagtgatggaccatcctgagcttctctcaggagaaaaatcaagaggggcccaacttgtaatcataggagcttatgctattttaatgccatccatcagactacaatcaattaccactcatctagctttttgtccatctctcattcttgtacatcctgagatagtcaattctgagaactgtagcctagatctatcacctgatgcctctcaaagatataatccgtgcttctcaagctaggctatgcacacaaatcactgcatcttgtgaaagttcagattttgaatcagtagttcaagggtggggtttgagattttgcatttctaatgagctctcagatgcttctgacccatggaccacactttgaataccaagaagtggtctgtagaccaatattggtcccttaagttccctcaaacatatcttcgggaaacgtcctttgattttccctacatttaaccattagtgttgcaaattctctcaaagtttgtcaagatatattgtagctaaaataaattacatttttcttgggggagagtactacctcatattaacttacaataaagtacttttaggatcattcaaggaacacacccataacactgagtatgttatgcggaaatgctctctctggaaattacacagctgtgcaggtggcgggggtggcatgaggaggagtggatggcccacattctcgaagaccttggggaaaactggattaaaatgatttgccttattctggttctgtaagatacacatcagaatgaaaccacccccagtgtacctctgaattgcttttctattcttttcccttagggatttgagggcttcacttagatttctcttcatctaaactgtgatgccctacattgatctgatttacctaaaatgtctttcctctcctttcagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggtgagtggatggtacatggagaaggagggaggaggtgaaaccttagcaaaaatgcctcctcaccacttcccaggagaatttttataaaaagcataatcactgattctttcactgactctatgtaggaaggctctgaaaagaaaaagaaagaaacatagcaaatggttgctactggcagaagcgtaagatctttgtaaaacgtgctggctctggttcatctgctttctattactacaataatgctaagtaaaaaacctccaaaaacctcagtggcatctaacaataagcatttgttgctcacactcatttcacattggttttggttgtgaattacatgtttgcagcaggcaccatagtggtgtgtgatgtccccttagctgtatccacatatggacacaggaatttgctctttttatctctttttattttcttggttacagacatgtgacttttttttttgaaaggtaacaatcactttctcatatgttatttgatgctagtggtcatagcctattagtcacatttgtttcaatgagaaagaaaaaccagtacacggttatgctaaggatttcagtccctggggtgagagccgtctcgaatgtctccccacttcataactcctccacacatcatagttggatagtgagctctgctgatattggcaggacttgctctggtctggctgtagtctgacggagcctggccctgggtgtgctgtgcaggctgactcagctctccccacacctatctcatgttccagtcaggcagtaactggtgaagaagccaagctaggaaccaggatatctggctcctgagctaaagtcttaaaacactatcatattgccttccaaatataacaccaaatactaggtgcatatcacccacactgttttcagacctctgccaaaattgggattctttgtggtatgaagagacacggctttggggctggcccggctgtggcagtgaggtgaacacaaagggatgttcttcagagattacagtccagccctgaagcaacaactaggagactgtttcagcaagtgaggacagggctgtgtggggttctatcctctttataacttccactagcactgaaatcgtgttctctggttacatccaaccagaaccttctttgtcatttttgggatagaaagggactagtttatcctcaaattatttatggagattttatataatatagtgtttctctccacattttctgtatataacaaaagtcctccttttagtgtgtgtatacacatatatatacacatatatatgtgtgtgtgtatgtgtgtgtgtatatatatatagacatatatacacggttatgctaaggatttcagtccctggggtgagagccttcccgaatgcttcccaccttcataactcctccacacatctcagtgggccactgagcacagcaatgggcatgacagttattaaaacactttataaatgcttcgatcctttaccagtatgagttagtctctggagctcctaatacttcattagtactgcatggactgagttaaaagttaattcaaaatctcaatttatccaaatctgtttcgttctttccaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaaggtacaaggcccctgggaagggagccctccctgaaccagcctggttcaagcatattctgcctctcttaatctacaggacagtcatgtggttgtataattatttgcttgtatttttatatttagagatttttttaatcatcaaattgattattgtcacactttacaaaccatagactagaaaaaagaaaactacagtcatccacaattccaacaacttacgatgaaggtcatcagttatgtccttatgggtcatcagtgtccaaaatgtaaggactcttttaaaaacacatgatcacaatgctattattatgtcccccaaatgaatatttttttcataaatataatcaaatatttaggaataacattttaataaaaaacatgcatctaatcttcaaagaattttatagcttactggaacagatagacaaagaaagcagtgatgatactgcattacatcggtacagtagcatcatatgcctgtgtaaattatctgacttcaactattctatggaggtgtgggggagaaagagggagagatggagagaagaagaaggaggagaaggagggagaagacaaggtaaggaggagaaggaggagaattagaaaaacaagagaggagatgagaaggaaagtgcaaaataacaattttgaaatagtacaagacaatttccccttctccttcctcatgaccaatgtaagtgtgacttgaggcaggaacctacttttccatcagtcagtcccatcacttatgtgccttttatagtgtggacacatcaccaccctgaatataatttcagtgtttagaaataagtattctttgcaacactatttatctcatctcaacaagactgaaagctcctatagtgtcaggagagtagaaaggatctgtagcttacaattctcatagcaaaataagcatagcaggatttcaatgaccagcccacaaaagtatcctgtgtactactagttgaggggtggcccctaagtaagaaaccctaacatgtaactcttaggggtattatgtcattaactttttaaaaatctaccaacgtggaaccagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacaggttagtcaattttctataaaaataatgttgtattaataattcttttaactgagtggtctgtattttttaaaaagaatatgcttgtttaatcttttactaatttgttctctgggccaaagaatcaattaggcccatctgtgatctttaagggtgcttcagttctggagttcaaaagctgtagcatcaaaaacatcatgtaaagcccatgtagattagcatggcataattatctgcagtctccttgaacttgagcaaagtttacattcagtttcaagtcgattggaaagatggggaagtattttgcacagtcatgaagtgtaatgattaccttgttgtgacttttgaatgctgctcttcccaaccagaacttggagaagctttctcatgagagtggctcccaaccactagctgtacattggaatcaccagggagctttaaaaattcatgatgtctgggatatcacagaaattctaaactaatttgcccagagtgtggctttaaaagcttccccattgcttctcatgtgaagccaaggttgagaatgactaatttaaggcatttctggtggatataaaggactaccacagtccaaggccatcctgactgacctcaccttccaggtgcctagctccatccagctgggctccttttcaacccaattataactctattaatgttgttcccagccaggcatggtggctcatgcctgtaatcccagcactttgggaggccgaagcaggcggatcatgaggtcaggagatcgagaccatcctggctaacacggtgaaaccccgtctctactaaaaatacaaaaaattaccctggagaggtggcaggcacctgtagtcccagctactctggaggctgaggcaggagaatggcatgaaccccagggagcggagcctgcagtgagccgagattgggccactgcactccagcctgggtgacagcgagactctgtctcaaaaaaaaaaaaatgttgttccctttctcctcattttgttcttatctttcaagtcctagttcaatccccaagcccctccaaagtgtcttctcctcctagtccagggcccatttacttctctgctctgttattggatactggaggctattatcataaatttgacaatttgccattaaatcattgagttttattctctatattttctttgtatctaaaatgtcttcccccctccattaacaatatcctctcattttattcctttttaaaatatcccagtggtgccttgcaagggactgtatctaatgcaagcatttggtaaatgtttaaggagtgatgtgcagttgatggcttgcatacatatattaagctatttaatgtgaacctttaaacaaatgccattcgtgcatatgcatgtgtgtgtgtgtgtgtgcacatgtgggcatgcatgtctgtctgcagtgaaaatatattcagggtttttgaaaatttttaaataataaggtattatatttatagaaagatttgaaatattttctctgaagaagttaaagaacagacgtcattgattcatattaaacaataccctataaatcttatttctaggtctcatgtatttattattcaattccaccccttaagtaggctttctatataggagaggaagaagacagaaatagtttccatattatttccatattccatattatttgtggctttaggccagcagtgtagctgtattatatgtgcccagacaggggactcagccctgaataaaagtggtcctctggcacacctgggatggggaaggtactccttggtaagctcccaacctggcacttcttgatctccctggcaattttcttgcccattactccatggagatcagaatatcactctgttgtgtcccctcaacacggaaggagtgtctcaataagaatggggctaaaagttgagtccaaacactgtaggaattgagaggttccccacttgcactacccttggaagccaagagaagatgttaaaaaataaaatggtaatgcttcctgaaggtgtcttcccatctttacactggatgggttcaattgggaggaattactggactctggaagttgaagactgtccatataattaaaatgtacaataactacccaggtttaccttgcaagtttcaacatacacaaaattaactttatatgactcttcaaaaacagtttgccatcatacctaataatctggtttaaattttaaaaactcatccattttacttaaaatttaaatcaaaaaagaacacaggtttccatgaatttgtctcaggcctggcacagaatagtactccataaatattttgttaaatgatagatgatgaatgctctcactgtccaatcttcacacatcttatagactaagtataaagaatccaagatttatagtgctgaaagtagtttttatatgtttacaaagcattattgtcattactgcattttttttgcccattactccatagagatcagaatatcactctgttgtgtcccctcaacactgaaggagtgtctcactcactttgatgctatactttctacttttgtttatttaatgcttctcaatatgcttgtttaactgttgcagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcctaaaagcactcattccttttcttttccaaattcttcctttattttcccttcctgaataatttagtcctaaagccattaggtgggtggcagccagatggtggccacacattaaggtagagaagagagagtcatggtggctccaagtcagagaccaaggaggttcatgtggagagacatcctggcctgggtgtgggagtccaagcaagcagagaaggggtcgacgcagaggggtggcttgcaagagcagccagagcctaaatagggtatggagaacccacatgaggcgaggagggcatccatgagtgggaggggttgggtgaggtttggctacataaaggggattgatcaaataagtaaatgtattaaggatgatagaagccaggcttctcacctttgcagaagggagtcatggattcagaaagggagaaaactagcatgaatcctatgaaattagattggaatggatgtaaccgtgtatattcatacccttgtagatagatagatgggtagatagatgatagataggtaacagatagatgacagataatgagatagatagatgtaaatgtatgtctgtatttgtgtgtgtgtacaaaaaacatatattccctacttctctccactgatagggctaggtaacaatgacatttcaatagcaatgaacacacttagtgccccgatcttggcttatgaataccattttccactgaagggaaccagagctctttagagaaatggctgatgccagggcaagaattaagaatgttcaagataagtttaggacacattttgtgccaggaagcaagaaaattttcaaataatttccaagtaatctttggaaatgatacttgaaaatgacttccaaatgacatttccaaatgacttgcaaacgatttccaaatgatatttggaaaaacctaaagactccatcaaagaactattggaactgataaacacattcagtaaagttgcaggatacaaaatcagcatacaaaaatcagtagcatttctatatgccaatagtgaacaatctggcaaaaataaaaaagtaatcccatttacaatagccacaaataaaactaaatacctagaaattaacttaatcaaagaagagaaaggtctctacaatgaatactgtaaaacattgatgaaaggaattgaagacacaaaaaaggatatttcatgtttatatattgtgagaatcaacattgttaaaaatgtccacactactcaaagcaatgtacagattcaatgcaatccctcaaaataccaatgacattcttcaaataaatagaaaaaaatcccataatttgtatggaaccacaaaagacccataatagccaaagctatcttcagcaaaaagaacaaaactggaggaatcatgttacctgacttcaaattatactacagaggtacagtaaccaaaacagcatggttcttgtataaaaacagacacatagaccaatgaaatagaaaagagaacccagaaacaaatgcaaacacctacagtgaactcatttttgacactgctaccaagaacataccctggggaacagaacatctcttcaataaatggtgctgggaaagctggatatcaatatgcagaagaatgaaactagacacctatatctcaccagacacaaaaatcaaatcaaggtggattaaaggctgaaatctggctgagcagggtgactcatgactgtaatctcagtactttgcagaactttgagaggtcaaggtgggcagatcacttgaggtcaggagttcgagaccagcctggccaacatagtgaaaccccatctctaccaaaaaatacacaagttagctgggcatggtggtgcattcctgtagtcccagctagtccagaagctaaggtgggagaatcatttggacctgggaggtggaggctgcagtgggccgagatcattccaatgcacctcatcctgggcaacagagtgagacagactgaagtctaagacctcaagctatgaagctgctacaagaaaacattgtggaaactcttcaggacattggtctgggcaaaaatttctgaagtaataccccacaagcacaggcaaccaaagcaaaaatggacaaatggaatcacatcaagttaaaaagcttccgtgccgcaaaaaaagtaatcaacaaagtgaagacacaaaccacagaatgggagaaaatactttcaaactaacattctgacaacagattaatagccagaatatataaagagctcaaacaactctgtaggaaacaatctaataatccaatcaaaaaatgggcaaaagatttgaatagatatttctctctctcttttttttaattttgagacggagtctctctctgtcgcccaggctggagtgcagtggcactatctcggctcactgtaagctcctcctcctgggttcatgtcattctcctgcctcagcctcccgagtagctgggactacaggtgcccgccaccatgcctggctaatttttttgtatttttagtagagacggggtttcactgtgttagccaggatggtctcgatctcctgacctcgtgatccacccgccttggcctcccaaagtgctaggattacaggcgtgagccaccgcgcccggcctgaatagacatttctcaaaagaagacagacaaatgccacataggcatatgataaggtgctcaacatcattgatcattagagaaatgaaataaaaaactatagtgagatagcatctcaccccagctaaaatggcttttatccaaaagacaggcaataataaatgccagcaagaatgtggagaaaaggaaacccttgtacactgttggtgtaaattagtataaccactatagagaacagtttggaggttcctcaaaaaattaaaagaaagctaccataagatccagaaatcacagtgcttcggtatatacctgaaagaacggatatccgtatactgaagagatatcttcacgctcatgttcacaatagccactactcacaaatgctaagatgtggaagcaacctaagtgtccatcaacagatgaatggataaagaaagtgctccacttatacacaatggagtacaattcagatacgaaaaaagcatgagatcttgttatctgtaataacatggatggaactggaggtcatcatgttaagtgaaataagccaggcacagaaagacagacattgcatgttctcacttatttgcaggatctacaaatcaaaacaattgagctaatgtctgggtcttagtcaattttgtaccctaagtactgtgagcacagcttttaaaatacatgatgaatgctttaatacaggaatgaatagataagaggcacagggtgcctctgggtgttcttctgatacatagtatcttccttgacacattcagtacaactctcagcaggtaagtctcttcatgttatgttaccttctgaggaattaggtggcagaacatgccttctactattttcctttgcagaacaagaccagttgcattagttgggacacagtgctggctacatttgagtcccaagcaacgattagtctattgctgagagtaattagtctatttctacagacttagaggggatgacacacaggggcccagcaatctcacccaagtcaactctgccaacctttctggtcacccaccatgtgtacagtaccttgctagggtccagggtcatgaaagtaagtaataccagactgtgcccttgaggagctcacctctgctaagggaaacgggcacagaaacccacaatggtgctagagaggaaagaggacaataggactttgtgaggggataggaggcacccagaggaagcaatggttacatctgtgtgaggaggttggtaaggtaagactttaacagaaggggtctgtctgtctgggcttggaaggatgtgtaggagtcatcgagggggcacaggtacactccaggcagagggaattgcatgggtaaagatctgtaggtatggcttgtggggatggatttcaagtattctggaataaggacagccatggaaacaaggacaggtgagaggagatttaacagatttcatgccaacatggcacatgtatacatatgtaacaaacctgcacattttgcacatgtaccctaaaacttaaagtataataataataaaattaaaaaaaaatagagttcataccaatggccccacttcagtttctgataagaactcagattccttggactccctgataacactgattaagttgtttatgattcctcatagaacatgaactcaaaggaggtcatcaaaggggtgtgtgtgattctttgctactggctgcagctgcagccccgcctccttctccagcacataaacatttcagcagcttgtcctaagactgctgtgcagggcagggaagctccaggcagacagcccagcaaacagcagcacacagctgaaagtaagactcagagaagacagttgaggaaggaaagtggcaacggacctcatcccaaatttggcggtggaaacctggcttctccttgctgtcagcctggtgctccactatctgtcagtaactgtccagattcctctcctctgttaacttggacttggggtgctctcaggcccctgctcccttatctgttttgaagatcaaaagagatgttcaaggaggagtagattaattgttggatgctacaaacacataaaggttattattgatcttatgcagatttatgaataaataaataagcatttgtcccagctaccttctcattttggtaactaggagggtttagggacagcatttggtagtgggaatgatctgattaggttagatttgacctatactaatcaacaaaaacccagcaaaggcagattacaaactgctgaacacgatggggagtgtgatcctcatccccttcccaggttctcaggattctggggacaggagggagcagcttgggtttttgtctcattaccttcattttctgggttctctgtctgctggaagagatgtgtagaagtttgtcccctgtggacctggtggttcctgctcccccaacttccaccccaggatatcatttacataacgcaccggggaacaccaagacttcacgggaagctgtcccccggctcttccctctttcctgtgccatgtcccaaaacatcccctcccacctatgactcactcctccaccctgtcatacacagaactatttaccttgcaatgattaatctccagagcaaaggagacttggaggaagttttgaagatttattctttgctttaatctttttcctcccgtctctgggaggctagcattaatatagagctttgtttctcacctaatgggaatctgctagcagcctgaaaaggcaggagctgtgaaagccaatttggattttacacattttttcccctttgtgttacagtaaaggaggatgaaccctctcactggtgggattcctggcatcctagagcaggtggagagaagagttacttcccactgtgggtagtggaggctccacctgttccattaacttctacctcaatttgacttttattaagagcagggaaccacaatgacatgaaaatagacactataaaactaattttaattctttcacagaaagcttaggaattcagtgaatagtggcaacatagtttccattttctaacattttaaaataaattgatatggtttaaattcattcatttttaaaccagaattttttggagatagactatttccagcatgttccttctggatgataaaagagggctgttagttcagtatttgtgacaataaatgtgtgtaaaataacatcacctttccagaataatatcaggaatatgagtctaatacatgaatgtatatctctaagacaagactgcatatgtctttttaaatatacatgcctgacagtttattgtaatacctcctttttgaatatacctgcttagcaggctaccttaaactctcaggcaggggagtaagcaatactgtgagctagtgatgatagcaaaggcatccagataggatctgcatgaagtgagaaaatattcctcagctctcagggtagaactccaaagagatattcatgggtcctggccccacagtggaggtcactcaaagggcaaacagattggcatctcatctgcttcaagcctggatacagggacatcaaatgtgtcactctgtgtgtggtctgccatgttgtggggaggccactacagactcgggcagctgggcagacaataccttagccttagacgatgctagtgtagcccaggaatcagaaactatagtgtagaccgtgccctccttaggccaacacaattacatgcaatagatgacgggcttttctgttagcctcttcattggaactgaaagtggcattactctaccaaacagaggagagctggaaagaaactaaacagtttgcccagcacagcctctgccttgacatggaaccatgtgagtctagacactcacctagatctttccctgggggccaatgctgctgacacattaactcattagtttgtcctggcctgagagatcatgtaacatgtagaaggtttagaagcagagattagtgtcattaatttgccatggctgtgacaacaaaggaagaaactggggtgggaaaccccaaggccaccctggttttggtagatggtgcacacacttccactaactattctggggcaaggatccaaatgcactatatgctgcctctgctgggatctccaaacacgaccctccatgccatttctcagttgtattttaccacatattatcagagtcactggatttgtacagaatgtttggaacctatactgccttaagtgctacctgttatagaagagaaaacaaggtcttaattcaactatctggaacattttatggttacttatgtaaaatactgcatcttttgctatcaacaggaaggtacatggacattagaaggcccctgcctttcagctgaaagcacatatgaggcatatggatccatttatatacaccatacttttcagctgcattttcctaatttgcctctctggggccaaccttgtgggactagcagattcacggttgaattgatggctggtgatgtctgccatcagcctttcttcttcctctagtcctccgctcctcagtaacatcagactgggaaggtcttcagacatccagaacccccagttgggggagtccatacatgacccatcaaagatgagttgcaagcaggcctgccataaagagcagcagccttaatgggttttcctacagagatagtcaatgtacagaggcaataaactgactgctttgtgattgatcaccttgaaaaaatgagcatgtctggatatattagtcatttcttgcattgctgtaaagaaatacctgaggctgggtaatttataaagaaaagagatttaattggctcatagttctgcaggctctacaggaagcatagcgacttctgcctctagggaggcctcaggaaatttacaatcatggcagaaggtgaaggaggagcaggcggatcttacatggctgtagtagaagcaagagagggtggggaggaggagccacacacttataaaccaccagatctcataaaaactcattgtcacgaggacaacagcgaaggcaggatggtgtgaaaccatgagaaactgcccctaggatccaatcacctcctatcaggccccacctccagcatttggggttacatttcaacatgagatttgggtaggggcacagattcagaccatatcactggcactgtgcttatcagatgaatatcaccagttggaaggctagattccacaagaggaggaatgtcctggaaattggtttcttaagttgtgattcttctgcacactgtcattcagggcaatatgagtcaatcattctcccccatagctgaaatcaaccagatcatctgaccacagagactgaggtgtagctgaaaggtgctcgcatttctacgaggccagtagaagcctggagcacagttgtcaatctgtagaaataaggactctgactcctccaagacctctctgtgaatgacagtttaagaagggccagatcctaaaacagggtcagagcttagcagaaagggaaagcataaaagcctttgagcaattctaaagacagggccacaataggctctcagtgaccctctgtgactgagtggatgcagcgatgcaaaatctaaccattactgctgaagacaaaaaaaaaaagtcaccctttctacctaggatgagaagccctaaatcagtggggtccacttactaaatagacataaaggaatgaagtgccctggaagaattcctgcctgaacctctcaggagcactcatgtttgaggacacttatcaagtattcactccaggattgggaccatgaaaacttcagctgcttttagctaatcactgtgacttttggggtgtcacagtgcaggcaggaaaggacctgatgaacaaacataatcattgctgtcggagttactgttatttattgccttaatgttacctccttctcctgagcattacatttcctcagtcagtaactcaccatcccctatatctataaagtcacaatccttgagacatgatttctgtttcactttgtagatatgaaacccattcacatggactttttaaaaatcttggcattccaggtcccagacctctgctttttttgggaactactttgtcctaccatcaagtgagtgtttttgagctcactctttggcttcttatgattgcaaacagcagcttagttccatcagtaaaaatgtttctctgcaaaaggaaggtctgaggttttaccctttcagaaacagtgtgtaggcatcacccagagcatggcaatgtttacacaggggctctcttgctaactctcaggaacctcagatttgcctaatttgaacagcccaaatctcaggtagatcagcaacctgatgttcaaaacttgatatgcagactttgtgaacaccataaagaagattttctttttgctccgtgtaggttcccaggaaagtacagtcattgttagtattaaaagtcggaacaggatcccttgattgtggcttgttatctgtgtacatgagagtcaaactttcttctctgtagcaagagctcatgagtagccttttcccccttcctcctggacagctttgaaactcagtttattagggagatcaagtatttaccattgggtcatttgcacctgcttgaatcatctccaacaaatgctaaattccctaagggtttttccatggctctaccttagctcttactccccatgacgtcttttgcagctttgagacacacaaaaaaggggttctgctttacttctttttattcaaaggctgcactttattagtgagtctgaggaaggagtggatgtaactgagatgagatagtggttgtctatcaaacttggatctttttttttatataatactttcagttctagggtacatgtgcacaacgtgcaggtttgttacatatgtatacatgtgccatgttggtgtgctgcacccattaactcatcatttacaaggtatatctcctaatgctatgcctcccaccgcccccaaccccacatcaggccccggtgtgtgatactccctttcctgtgtccaagtgttctcattgttcaattcccacctatgagtgagaacatgaggtgtttggttttttgtccttgtgatagtttgctgagaatgatggtttccagcttcatccatgtccctacaaaggacatgaattcatccttttttatggctgcatagtattccatggtgtatatgtgccatattttcttaatccagtctatcattgacagacatttggcttggttccaagtctttgctattttgaatagtgccacaataaacatacgggtacacgtgtctttatagcagcatgatttataatcctttgggtatatacccagtaatgggatggctgggtcaaatggtatttctagttctagatccctgaggaatcgccacactgacttccacagtggttgaactagtttacagtcccaccaacagtgtaaaagtgttcctatttctccacatcctctccagcacccgttgtttcctgacttttcaatgatcgccgttctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatgagattgcttgtttttttcttataaatttgtttgagttctttgtagattctggatattaaccctttgtcagatgagtagattgcaaaaattttttcccattctgcaggctaccttttcactctaatggtagtttcttttgctgtgcagaagctctttagtttcattagatcccatttgtcaattttggcttttgttgccattgcttttggtgttttagacatgacgtccttgcccatgcctatgtcctgaatggtattgcctaggttttcttctagggtttttatggttttaggtcttacatttaagtctttattccatcttgaattaatttttgtataaggtgtaacgaagggatccagtttcagctttctacatatggctagccagttttcccagcaccatttattaaatagggaatcctttccccattgcttgtttttgtcaggtttgtcaaagatcagatggttgtagatgtgtggtgtttgttctgaggcctctgttctgttccattggtccatatccctgttttggtactagtaccatgctcttttggttactgtagccttgtagtatagtttgaagtcaggtagcgtgattcctccagctttgctctttttgcttaggattgtcttgggaatgtgggctcttttttggttccatatgaaatttaaagtagttttttttccaattctatgaagaaagtcattggtaacttgatggggatggcattgaatctataaattaccttgggaagtatggccattttcacgatattgattcttcctatccatgagcatggaacattcttccatttgtttgtgtcctctttgattttgttgagcagtggtttgtagttctccttgaagaagtccttcacctccctttaatttggattactagatattttattctcttagtaacaattgcaaatgggagttcactcatgatttggctctctttctgttattggtgtataggaatgcttgtgatttttgcgcattaattttgtatcctgagactttgctgaagttgcttatcagcttaaaaggattttgggctgagacgatggggttttctaaatatacaatcatggcatctgcaaacaggaacaatttgacttcctcttttcctaattgaataccctttatttctttttcttgcctgattgccctggccagaacttccaatactatgttgaataagagtcatgagtgagggcatcgttgtcttgtgctggtttcaaagtttttgcccattcagtatgattttggctgtggttttgccataaatagctcttattattttgagatacgttccaccaatacctactttattgagagtttttagcaggaagggctgttgaattttgtcgaaggccttttctacatctattgagacaattatgtggttttttaatcgttgattctgtttatgtgatggattacatttattaatttgcatatgttgaaccagccttgcatcccagggatgaagcccacttgattgtagtggataagctttttgatgtgctgctggattcagtttgccagtattttattgaggattttggcatcaatgttcatcagggatattggtctaaaattctctttttttgttgtgtctctgccaggctttggtatcaggatgatgcaggcctcagaaactgagttagggaggattccctcattttctattgattggaatagtttcagaaagaatggtaccagctactctttgtacctctggtagaattcagctgtgaatccatctggtcctggactttttggttggtaggctattaattattgcctcaattttagggcctgttattggtctattcagacattcaacttcttcccggtttggtcttgggagggtttatgtgtccaggaatttatccatttcttctagattttctagtttatttgtgtagaggtgtttatagtattgtctgatggtagtttgtatttctgtgagatcggtggtgatatcccctttatcattttttattgcatctatttaattcttctctcttttcttctttattattctggctggcggtctgtcaatttttttgatcttttcaaaaaaccagctcctgggtttcactgattatttgaagggttttttgtgtctctatttctttcagttctcctgtgatcttagttatttcttgccttctgctagcttttgaatgtgtttgctcttccttctctagttctttgaattgtgatgttacagtgttgattttagatctttcctgctttctcttgtggtcatttagtgctataaatttccctctacacattggtttacatgtgtctcagagattctggtatgttgtgtctttgttctcattcatttcaagaacatctttacttctgccttcattttgttatttgcccagtagtcattcaggagcaggttgttcagtcttcatgtagttgtgtggttttgagtgagtttcttaatcctgagttctaatttgattgcactgttgtctgagagacagtttgttgtgatttccattcttttacatttactgagcatgctttatgtcccattatgtggtcaattttagaataagtgtgatgtgatgctgagaagaatgtatattctgttgatttggggtgtggagttctgtagatgtctattcagtccactgggtgcagagctgagtggacatgaacattttatcaaagaagaaacacagctatcaaaaatccagaaatattgaaccttgttaataataaagtggctggcctctggttcattcctgtaatctcagtcctttgaaaggctgagaaaggaggatcacttgaggccacaagttcaagaccatcctagacaagtcagttcaagaccagacttcatgtctacaaaacatcaaaaaattagccaggcatggtgatgcatgcctgtcatcccagctactcaggaggctgaggcaggaggattgcttgagcctgggagattgaagtggcagtgagccatgattgtgccattgcactccagcctgggcaatgcatcaagactctgtctaaacaataataataataatagtaatagtaataataataataataaagaaaacggttgggacgccattccttacttattcaatacacaaagttaaaagcaatttctactttctctatttttttattactaaaaaaagctgaaccattctcacagcctgaaatgcttctcaccttcccctcttctatacaaacacttctctgttgatgataatgcagacagtctctcctttaggaatacttcacaccaggtagttccagatccccttatctctgccttcccagagctcctggtgtctccccagttccctctgtgtggtgaagtacccccaccttgggtctcagcatgactcgttctttgaaggtcttgttcacattttcccttatggttctgttcccctgtgttgtgtcacagcactgggcagagtggacaacccattcacaccgatagagagggccccatggttctggagataaccatgtaactgatcagaatagggcattgagggctgggtgtcaggcatgggctgcacttgggtgggcaggccccctggaaagtcacaggatttggcaagcttcctagtaacatctctccctggggtcctcttggaacttcatgcccgatgctggatgctggtttattctcgagagatggttcattccaataatcaatgaaactcatgtcccaactaaagttcataaactccagtttgtaaactgagataatctcagctgaatgaacttgctgaccctctgctttcccccagcctctcagtgcccttgaaatcatgtcagttcaagcagccccatgaggcattacaatgtttagttatttcagtgtttattaaaccttgccctatgctgaccccaggtgaatcacaagctggacttctgacaaggacaagctatgatattcttttcaattacagaaaaagtaagttaactgataggattttttaaagatgttactagttttggaaaggtaatttgtgcacatggtaaacaagaaggtataagaggataatgcttttatactgctgagaataatgttttctctaattttttttggtagatgctttcatcagattaataaaattcactgctgttagttgttgaaggttttttatatcatgaatgggagttgaatattatcatgtattattaatatattattattgaactagcaaaggctcttcctaaaacaattgagatgatcttataatcattctcctttaatctgttgatgagatcattggtatttatactttttctctgttaactattcttgagtctcaggtttaaattcaacttggtcatggtgtatcatctttgaacactcctgtctctggcttgctactattgtgttcagcatttttgcactgatgccgatgaatgagactggcatgtcatcttcctttgcggtcctgatttttttcagatttggatcatgtggccctcattgaatgagttgggtgtgatgccttctttttcatgtaactggattgatgggacactttggagtctctccagatggccctcaatggtccctgcctcctcattgttaggctcctaggcaaccctttctcatttctggtaggcccaggaacctgtgggttttatgtttgtttgtttgtttgtttgtttgttttttgagttggagtcctgctttgtctcccaggctggggttggagtgcaatggcctgatctcggcccactgcaacctccacctcctgggttcaagtgattctcctgcctcagccttctgtgtagctgggattacaggcatccaccaccactcctggctaatttttgtatttttagtagagacggggttttacaatataggccattgtgatctcttggacaggctagtctcaaattcctgacctcatgatctgcctgcctcagcctcccaaagtgctgagattacagttttgtgcctccacacacagtgaatctgtggtttttaaaagctcctcatgcatgtgaattctgtgagcatcccgggatgacagccactgtgtgtccagctgttaaaactgtgagaaagcaccagcgggaccctctccagcatttgcttgctgtggtcatgaaagaggcttgttggggagatgatgccctggttgactcctgaaggatggttaggaatgcaccagatggaagctgggttggacccagtctatgctaaagaacagcttgtgtggacacaaggagacacgaacacatcatttttgcagagcctggggagtagccaatcgcaccatttgcttaaaacaccgtgtacagttggagaagtggactgagacaggctgaagaagctaacagtggccagatgagaaagggtcttgtgttacttcctagatatacttagattttatcctgtgagtgataggaacagttgcagggactgaagccaaggaagcatgctttaagattccatgttttttgagatgctgtctggtggctgagtagggaattccctggataagtactgcccagggtaggcaaaagaagctaggaggttactgaaataaggagtatgagaaatggtgtaggttttgctgatgttttgtaacacatctcatgacaatcttcatttccttcaccaatttcctgtttcattaattcccttccacgtgctcttctgaaatttgcctcatattctttgatttctcttttacatgttggtttcatcaccttttactttttgctttcctggaaacacaaatgattctgattgtgacatgtcagaattatttgcaacattcccctttctgctgaaacatgagctcactgaatacacaatttagtaaagtgtaggatgcacatgttgttttcatggtcataaccagctctgtagcattttataactacactggcagtgtgctgggaggtgtagagagaaatatttatctcatgtgtggctgacacaacctgccaagttgttttaggagccttcttggaatcccagcaagaacaccactgatgcaatttgaaatcacaatgtcctgctccatgccctggcttcatggcttagtcacgtctgaagtctatttctaactatctgtttccacatctataaagcatgagttaaatcatcctaatactactcatcttacaaagttttcttgctgatattaggagagttgggaaagaactgtataaattatgaagtgccatggagatgttggtggttactttatcaagaaatagacactccagaatagagtagaaagaaaacagttatgattaagtcctcctcctcttctttttttttaatttacaaagaaaggtttaattgagtcacagttccatatggttggggaggctcagaaaacttgcaatcatggcagttggcaaagtggaagaaggcaccttcttcacaaggtggcaggagagagagagctcctcttcttttttgttgtaaagtctacagaagtgcatatacttcagggcaagggcaggcagggagaagaaaggacattgcttcaccccagtcctcactgacaagtttgctttgggacttcattttgtcccagcatatgggacagagctctggccactacccattcagaaggcctgagctgcattgctagttccccactaactctgtgtgtccttgggcaaggctgggcttatgtcaaaagattatgaccctgggctctccagctacagaatctacatatgaatcctggctctgctagagcaattagtgacgtaaccttggatgggtcagttaaccttcctgtggcttagtttgctcatctgtaaaatagggatcataacaacatcaataccatgggttgttagacagattgaatcagttaatgcagggtaaatacttagcatgacacgtattcactatcatttccttgagtaaaagctgagtgtgagtgggtgtgagaatgtgtgaaaccctttcactgcaatctcagttaagaaacccatccataatttaaagttcagggcctaaatgggtggttatcttctcccagttgcatcctatcccacctttgctcttctcctgcctgtaggagctgttggtctttgattgggctggaagacctggtggaccctaagtgatctataagagaatgagaatagaggacagggaatgtcttcaaaactcctagagggacacagaggctgagaggcaggcagtcctgcaggggtcttctgattgggacaaggaggaccttggtcttcataggccaattctggtcaatttcccccatggacagatgaggaaacagatccaggaatatccaaggtctcacacttcccatctgtcaagtcttgttgattctgttgtattcatgtctttcaaagagagagagagtttaaggaaagaaagaaggatcaactgtgtctgatatcactgggagcttaagtaaagggttcttttacttcatagcatttttcccaatttgtaattcagtattatttttgtcactgtttagtatctctttgtcctattagagagatagcttcatcaggacaaggattttgattctttaatatttagtgcttgccacatgccctgaacacagcaggcatacagactaaccaacatacagtggcatcgaagtgagacacctacctcctccagtgcctagagtacatgtccatggacctgtcactctcctcaacaccacccctaagcatgaggcccgaaagcattgctaatcccctcctccagccaccaaaacttaaaggccaggtgtggtggctcctatctgaaatctcagaactttaggagacagcagcaggaggatcacttgaggccaggaatttgagacgagcctgggcaacatagctagacaccatctgtactaaaaattagctgggcatggtggtatacctgtagtaccagctactaaggaggctgaggtaggaggatcacttgaacccaggaggtggaagctacagtgagctataaccacagcactgaactccagcctgagcaacagagtgagaccctgcctcaaaacaatttcaaaaataaataaataaaaacaaaacttagataccacgtggtcaccccaacatgcaaaatcaagttttcccctactgagaagaatggggacttgagagctgagttacagagagataatctgtcttttttttttttttttttttttttggtttacatcctcaagatcatgacctgtgaaatttgaatctaatacacaaatcattccagagcaatgttgcttctgcctaccacgagtaattcacttggccactggaagtcagaacaagcttcccagaagagaggtaccacttggactaccaatataaaaggatgaaaatatcggagtgaaggtgttccttgcatcactgagtccctggacagcctgtccactcatgctgatatctgagcctaatgcttctctgaatgttgagatttaactttgatccaatgaaaccagaccaagaaagaagaaacgtctttcattgttgataaggacatgatttttctcacaattttatgattatttttccttagctgtcctataattatctgcttatttgtctcttctccatgtgcttagggtacaaagttgaccaagaccaagaataatgtctgggagcacaatactgacagcacagctttaaaaacatgatgaatgctttaatacaggaaatgagtaggggagaggcaagtgttgcttgggtgttcttccaatgcatagtatcttccttgacacagtcagtgcagctctcagtaggcaagtccctacatgttagaagatgttactttctgtggaattaagtggcagaacatgccttcaattattttcctttgcagaacaacaccaatttcattagttaggacagagtgctggctgcatttgaattccaagcaacgattagtctatcactgttggtatagattccaaccagtcacaccacctcctgaagtttgtagggcaggtaaatcttcatcttagaataaaaatcatcttagccaagtaagtgttttagaggaaagaagaaaacataatcgtttccataagagttttgtttctaaaaaaataagaaaggctctttgtttaggtgagctaatgaagttgttgatagttatcagatgacactggaatctttacttgtcagaatgtgttctgtgcacctctcggtgtggcaacatagagagggagatcctccagcaatgccattgatatggtcagaaactgcatctttctttctccctgctgagatggagtcctttgttctagaaaacccagggggtgccactgggagtaacccttgagacaggaacacgaatctcaaccaatttctggttgcagccttgagtcttactatttgccatagtgatgcttagcaaggaatggcaggtgcaccagagcagcagaggacctaatatctcccttcctgttaactttttataatattttattgtgatcagtatcagttgggaagctacttgcagtcactgagcctcagtttctacatctgtaaactggggatagtagcatggccctatttaatgtgctcagcgaagccactgaaaggagacagaaatgtaccagaattccctggacttttatcctacttctcctggggattgtcacccacctacccgtgtctgtcctttgttgctttgacgctgtcacttcttttcttaggtacctctctgtagggctccattattccagggattccagagttacagcacatgcatacctccatccaagcatgtttatttgtctcctgcttcactaggctgtccccaaggaacatgtggctcccggcacatacctggcacaacactgcacatgacattcacccacttggccttgaatctgacaaggaatctggcatgatgttcacctgctgaggccaggtgccgagcagccctggaggcttaggggccagagggatgggaaaaggtgtctttctggggtgagtatcagtttctgcaggagtgctgaacctgagaaagaataaagagagaaggaagtgaacaagcacagcttaaacatcatctgtttctactgagttttaacaactctgagattttgtttgtcatggaatccatttctcaggccaagcagacacagaacttgggtgtgagtgatgataatgagctgatataattttcacaccctcatcactgagatctctcccatcaggaatgggtcacagggctcacaggtggcagcaactgttattacaggcctcatctctaccagctcctggcacctgctctcctcccattagaaaatcctccacttgtcaaaaaggaagccatttgctttgaattccaattccaccctcaagaggctgggaccacctcattggagtccttgatgctgtgtgacctgcagtgaccactgccccattgttgctggctgaggtggtttgggtcaacctggccatctgggcagctgttctcttctcttctttctcccctactgtttccagacatgcagtatttccagagagaaggggccactctttggcaaagaacctgtctaactttctatctacggcaggacttttgaaagctacagaggaagaagcacaaattgatgctattccactaagccatcagctccatctcatccatgccatgtctcttttttaggggtcctcttgccaacagaatcacagaggacaaatctgaaagtgcagagacagcagctgaggcacagccaagagctctggctgtattaatgacctaagaagatggagtggtcaccagaaagtcagaggaagtgacacacaggggcccagcaatctcagccaagtcaactccaccagcctttctggtccccactgtgtgtacagcaccctgatagggaccagagccatgagagtgagtaagaccagactatgcccttgaggagctcacctctgctaagggaaacaggcctggaaacacacaatggtggtaaagaggaaagaagacaatagaactgcatgaaggggatggaaagtgcccaggggaggaaatggttacttctgtgtgagggggttggtgaggaaagactctaagagaaggctctgtctggctgggtatgaaaggatgtgtaggagtcttctagggggcacaggcacactccaggcataggtaaagatctgtaggcatggcttgttgggatgagtttcaagtattctggaatgaggacagccatagagacaagaggagagttaatagattttatgccaatggctccacttgagtttgtgataagaacccagaacccttggactccccagtaacattgattgagttgtgtatgattctacatagaatattaactcaatggaggtcagtgagtggtgtgtgtgtgattatttgccaactgccgaggtggagaagcctcttccgactgcaggcagagcacgggggccctgctactggctgcagctccagccctgcctccttctccagcatataaacaatccaacagcctcactgaatcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctgtgagtaactgttcaggctcctcttctctgtttccttggacttggggtgctaatcaggcctctctttcccttatctgttttgaatagcaaaaaggatgttcaggctggccgtggtggctcacacctgtcatcccagaactttgggatgctgagcaggtggactgcctgaggtcaggagttcaagaccagcctggctaatatggtgaaaccccatctctactaaaattacaaaaattagctgggcatggtagtgcataactgtagtcccagctacttgggtggctgaggcaggagaattgcttgaacctgggaggcggaggttgcagtgaactgagatcatgccactgcactccagcctgggtaacagagtgagattccatctcaaaaaaaaaaaaagagaaaaaaaagaaaaaaaaagattttcaaggagaagtagcttaagtgttggatgctacaaacatatagaggttatgatggatgttttgcagatctataaaggaataaataagcatctcccccattcatctttagtggaaagaagggtttagggacagcattgattgaggataatctaatagacaatggtttgtacccagcttaccaaaccagaatttggattttacatttttccctttaagttgcaggagaagagggtgaatcttctcaccagtgagatcctggcatcctagagcaggtggagagaagagtcactccctactgtgtgtactggaggcttcccgcctgtcacattttacttctaactcaatttcacagttattaagagtaaggaatcatggtcacatggaaacagaaaatacaaacctcgttttaattctttcacagaaaagttagcaattcagtgagttgtggtaacatagtttccatctactggcaatttaacatgaattggtgtggcttaaattcatcctttttaaagccagatttttttggagatagactatttccagcatgttccttctgagtgataaaagagggctattagttcagtatttgtgacaataaatgtgtataagataacctcacctttccagaataatgtcaggaatatgagtctaatgtacaaatatatatctctaggacaagactgcatatgtctttttaaaaatactttcccaagagtttattttaatacccccatttcaaatacacctgcttagcaggttatcctaaactctcagggctagaaagtaagcaagactgtgagccagtgatgatagcaaaagcatccaggtaggatcaagatgaagtgagaaaatattccttacccctcagggtagaactccaaatagatattcatgggtcctggccccctagtggaggtcacttgaaggacaaacatgttggcatctcatctgcttgaagcctggacacaagggcaccatcagtgtcactctgtgtgtggctggccatgttgtggggctgtcactacagattctggcagtcaggcagacaataccttagccttagacgatgccggtacagcccaggattcagaagctatagtgtagaccatgcccttcttaggcctatacaattacatgcaatagatgatggatttttctgttagcctcttcattgtaacaaaaagcagcattactctaccaaacagaggggagctggaaagaaactaaacagtttgccaagcacagcctctgccttgacgtggaatcatgtgaatctagacactcacctagatctttcctcgggggccaatgctgctcacacattaactcaatagtttgtcctggcctgagagatcatgtaacatgtagaaagtttagaagcagagattagtgccattgattttccatggctgtgacaacaaaggaaggaacaggagtgggaaaacccaaggccaccctggttgtggtagatggtgcacacacttccactaactattctggggcaaggatccaaatgcactattgggcctggctatgctgtctctgctgggttctccaaacacgagcctccatgctgtttcttagttgtattttaccacatattatcagagtcactggatttgtacagaatgtttggaacctatactgccttaatggctaccctttaaagaagagaaaacaaggtcttaattcaactatctggaacattttatggttacttatgtggaatactccatcttttgctatcaacaggaaggtacctggccattagaaggtgcctgcctttcagctgaaagcacatatgaggcatatggatccatttatacacaccgtacttttgaaccacattttcctaatttgcctgtctggggccaagcttgtgggactagcagattcatggttgaattgatggctggctacctcttccatcaacttttctgcttcatccagtcttccacccctcagtaacctcaaactgggaaggtcttcagatatccagaatccccagttggggaagtccatacatggcccatcaaagatgggttgcaagcaggcctgctatagggagcagcagccttgatgggttttcctacagagacagttgatgtgcagacgcaataaactgactgctttgtaattgatcaccttgaaaaaaaatgagcatgtctggctgtattagtcttttcttccattgctataaaaaaaaatctcagggtgggtaatttagaaaggaaagagatttaattggctcatggttctgcaggctctacaggaagcatagcgacttctgccgctagggtgccctcaggaaatttacaatcatggcagaaggtgaaaaagaagcaggcagatcttacatgactggagcagaagcaagagagggtggggaggaggtgccacacacttataaaccaccagatctcataaaaactcattgtcaagaggacagcacccaagggggatggtgtgaaaccatgagaaactgcctctaagatacaaccaccatctatcaggccccacttccagaattggggattacatttcaacatgagatttgggtaggggcacagattcagatcatatcactggcactgtgcttatcaggtggatatcaccagttggaaggctagattccacaagaggaggaatgtccttgttcttagttgtgattcttctgcacagtgtcattcaggaaaatatgagtcaatcatcctccccaatagctcaaatcaatcagatcctctgaccacagagactgaggtgtagctaaaaggtgctcgcacttctacgaggccaatggaagcctggagcacagttgtcaatctgtagaaataaggactctgtgactcctccaagacctctctgtgaatgacagtttaagaagggccagatcctaaaacagggtcagagcttagagtgaagggaaagcttaaaagcctctgagcaaattctaaagacagggtcaccataggctctcagtgaccccctgtgactgagtggatgcagtgatgcaaaatctcatcatcactgcagaagacaaaagaaaaattgtcactctttctacctaggatgagaatcccaaaatcagggaagagtccacttactaaaaagacatgagggaatgaagtgcctggaagaattcgttcctgaacctctcaggatcattcacatttgagaacatttatcaaatattcatcccagactggggccatgaagacttcagctgcttttagctaatcattgtaactttttggtgtctcatggtggaagcatgaaaggacctgatgaacaaatataatcattgccgtcagagttactgttattttttattgccttaatgttacctcctttgcctgatcattccagttcctcagtcagtgactcaccagcccctatatctataaagtcacaatccctgagacctgatttttgtttcactttgtagatatggaacccgtacacatggactttttaagaagcttggaattccagggcccacacctctgccttttttgggaaatgctttgtccttccgtaaggtgagtgtttttgagcttcctcttttgcttcttatgattgcaaagagcaacttagttccatcagtaaaaatgcttctcctcaagaggaaggtctgagattttatactttcagaaatagcgtgtaggcatcacccagagcgtggcaaagtttaccctggggctctcttgctaactctcaggaacctcaagtttgcctcagttggacagcccaaatgtcaagtagatccagcaatctgatgttcacaacttgatgtgcagactttgtgagcaccataaagagcatttcctttttgctccaggcaggttcccaggaaggtacagccatacttagttagtattaaaagtaggaacaggagcccctgattgtggcttgttatctgtggacatgagagtaaaactttcctctctgtagcaagagctcatgaataggcttttttcccttcctcctgcacagcttggaaactcagtttattagggagatcaagtatttaccattgggtcatttgcacctgcttgaagcctcttcaaaaaatgccaaattttgttggggaatttccatggctttaacccaggtcttactccccatgacatctgttgccactttgagacacagaacaaaagtgttctgctttacttcttttcctttgaaggctgcgtcttgtgggtgagtctgagcagggagtggatgtaactgagatgagatagtggttgtctattaacctcagatatttaagcacaatatgaattcatgggtttattttttacacaaaggcagaatcacatgcaaaatcactagaaaggggatgatttgacaaaattattgaatatttaatttcactaaatagaatgtcatatgtgcctcatggactggggactttggtcgagcctttgtgcctaaccttatctgatgctgtgttcagggcctggtccctggatggaaaattatgagcttatttccacagggccagcagcagcaggagtcagctctctggcttagacaatctgacctgcatacctgaggcttgtttctcagattctagttctcctaagtgagggctttgttgtctaattactgcccaggaatttcatattttttccctctgcaaaagcaataatttccctactttcacatgcgtccgtgtgaggagaccaccaaacaggctttgtgtgagcaataaatgtttttaatcacttgggtgcaggccaactgagtctgaaaaaggagtcagcaaggggagataggggtggggcagttttataggagtggggtaagcagtggaaagttacagttaaaggtggttatccattgtcagcagtggagggggccacaaggtgcatggtggggagatcataagactcattgtgcagagaagaatgtcaccaggttgattgatcaatcagttgggacagggcaggaacaagtcataatggaatgtcgtaagattgctcaatcagttaagacaggagctggctgtttcatttcttttgcagttttcagttgcctcaggccatctggatgtacacgtgcaggcttgggctcagaggcctgacattcctgtctttttatattaagaaaaataaaacaaaatagtggcaaagtgttggggcagcaaaaatttttggggggtggtatggagagataatggatgatgtttctcagggctgcttcaagcgggattatgggccatgtggacaccttaaagaaaattttataatgagttacaaggaataggaatttaggctgtggggagatcttggggcagaggatggtaccatggacttgttaaaagtaatatttgttgtatagaataattggtgatagtctgaatgtgtttttatattaattgagaaaccaattgaagacacaagtcccgaataacagaaggagaaaaacaggtaccagaggactaagaatagggaggagctaagacacccagttagaaagtgtccaggtgggtccaaaataagtatttgcctggctggtgagtttttggtctttatctttaagcttttttatattgtcatataccaggccagattggtttagataaaaacaacattcttcatttaaaaatatagagtactcctttttcagcagtgagtaggtcaaggcctcagcgatgttggaggacgactagggctaagaagtcaacctgggtctgaaggactgataaagtttgtgatgtatctgtaatgctagcagaaaagtcattagaaaggctacagaaagttgtgacagaagttgaaatacctgctattccagctccaagggcaatagtggaagcagaaagtcctaaccctacaagtagagggattagaggaataactcatttttgtctggttggtgtcatgagggggacaggaagttgttcagtcccatttgcaaattgaattttttcaatttgggaataagaaatactagtgtacatgtacctgtccaattagcagatagacatatgtacgtggtggagccacagaggaagcagaggccttgtgtgaggcaaaactggaaatgcaaagtgaaaagatgagagggagtgccaaaagaggtgtcttgcacccagactcttagggatttagtgagggcatcagcccttagtggtcataatggggattgatggggcaactgggtatgagaaagagcatagtgtctacaaccaaactttcattgctattcatggggttcggtataagtaaacaagaagggggaatgggaggagagtctgaagaacaaggggaaggtagccaagaatggagtgaaatacagggcaaatgtcttaagggaaatgagaagttctaggagggggctagttgcttgtaacctacatggaagaggtcatgaaatgacaacagaatagaatgggcctgtgagactggaaggagatatttttcttggtctaagaaccatcttccttgagtggggagggattgatagatggaaacttcagtgggagagtaaataggagtgactgatgagaaggagaaaaactggccatgagggacagaagtaggaatactggttgcttctttagctgtcttatcagcataattgttgccttgagcaatggggtctgaggccctttgatggcctttgcagtgaatgactccagctttttttggaagtaaagtggccttgagaagaatttttattaaagaggcattaatgatggaggacacttgcatagtgaagaaacttctttcagcccatattacagcatggtggtgcaggatatggacagcatttagagtcagtataaatattgatgtgtagtccctttgcaagagtgaggccccaagttaaggcaatgagtttggcttgctgagagatagtggaggggggcagagcagtagcctcaatgatagatgtggaagataatatagcacagcctgcctttgctggtgagtggtgattaggcctggtggaactgccatcaataaactaactgtgattcaggtgaaaaacaggaaagaaggaaatatggggaaatagagtgaatgtcagatggatcagagagatacagtcatggggataaggtgtggtatcaggaataatgtgggaggccagactgaagcccaggccaggtacaatggtaattgtgggagactcaacagagagtgggtattgctaaaggagctggggaacagaaagtatatgcatcaggtgtgaggaaggaaatatattttggaagttatgagaactgtatggagtgagttgagcatagtttgtgattttgagggcttctaaaagtattagggtggtggcagccactgcacagagacatgatgaccagcctaaaacagtaaggtcaagttgtttggacaaaaaggctacagagcacggtcccagtccttgtgtaagaattccagctgcacagccctgcactttggctgtgtgtaatgaaaagagttgggatgagtcaggaagagctagtatgggaacagcctctagagctgtcttcaaggaatggaaagaggagtgaggaaaggatttaggacttatggggtcagctaggtttccctttgtgagtttatataatggttttgttaggatggcaaaaccaggtatccaaaggcaaaagtatccaaccatgcccaggaaggaaaggagttgttttgtagaaggggttggggtttcagagatcagccagacatgatcagcagggagaccccatgtgttttcatgaagaattatgctgaggtacgtaacggatggagaagaaatttgagctttggagggggatacccgatatcctttggagagtaaatgttgaaggagcaggagggtatcttgttgaaaagactcaaaggagggactacagagtagaaggtcatcaatatattgaataatgtgggaagcagagggatgggaagaaagtaaatcatgagagagagcttggctgaagtaatgagggctgtcccagaagccttgtggcagtacagcccaggtaagctgctgggactgatgggtgtcagggtcagtttaggtaaaagcaaagagaggctgggatgtgtggtgcaggggaatagtgaaaaaagcatctttaagatcaagaatggaatagtgagttgtggagggagatattgagaacaaaagagtgtacgggttgggcaccacagggtggataggaaaacaattttgttgataaggcgcagatcctgaacaaacctgtaagacttgtctggtttttagacaggtaagatgggggaattataaggagagtttgtaggctttagaagcccatgctgtagcaggtgagtgataacaggcttcaatctccttaaagcctcttgtgggatgggatactggcgttaagctgggtaagggtgattaggctttaatgggatagtaatgggcatgtgatcagttgccagggagggagtagaggtgtcccatacctgtgggttaaggtggggggatacaagaggaagacacgaaggaggctttgggttgggaagaaggatggcaatgagatgtagctgtagtccaggaatagtcagagaagcagataatttggttaaaatatctcagcctaataagggaactggcaggtggggataactaaaaaggagtgcataaaagaatgttgcccaatttggcaccaaagttggggagttttaagaggtttagaaacctggccgtcaatacccacaacagttatgggggcaagggaagcaggcccttgaaaagaaggtagtgtggagtgggtatcccccctatcgattacacaggggatggacttaccctctgctgtaagagttacctgaagtttggcatccgtgattctccggggggcttccgaggtgatcgggtagcatcagtcttcagccactaagccaaggagatctgggaaggagtcagccaagaaacattgggtttgagctccaggaactttaggagcagtggcgatgtgagtcagacagtccaacctctaattggagcccacacagacagggcacggcttaggaggaatcccaggctgtgggccttctgaggcccagtggccaggcttttggcatttgaagcaaggtccatgaggaggttttgaaggagcccctgggagctgtggcttggatgttctgaaggttttgtatgctggagacatggtcttgggttgtcttacactggaggcaagtagctataattcagagatgcattgtcacttggccgcctcttctctattatgatacaccttgaaggtgaggctatttaagtcctgttgtggggtttgaggcctggaatccaatttttggagattttttctaatgtcaggagaggattgggtcataaaatgcatattaaggataaggcggccttctggcccctctgggtccagggctgtgaagcatctaatggtaggtgctaagtgggccatgaactgggctgggttttcatctttaccttgggtagtttcctttagcttgtcataattaacagccttgtatgctgcttttttgaaccccttgactaggcaggagaccatgtaatctcacctagctatacctggggagtccatcttgtactgccaatggggatgctcttggggaactgccctgatgccttcttgaaggtctggctcatggcactggtgggtgtcagtgtgagattgggctagggtatcaactctttcctgctcatctggggagaggggggaggtcaggatgacatttcagtcactccaggttaaatcgcaggactgagttaaatattggaattcctgtatatatttagtggggtctgatgaaaaagagcctaaacgctgactgatctgggagaggtcgatagagaaaaaggcacatgtaccttgactatgccttcagctccagccacctgactaagagaaaattgttgggcaggtggaggagggctagtctcggaatgaaactgtaaggtggagtgggtgtgaggaggggaggtgatacttctattatagggtgggggagcagaggatgaggaagaattgggacctggcttggcctggtgaggagcagcctggtggggaggggagaggtcagatgggttcatagaaaaggaggattcaaaggactcagagcttagggtggagactgaagaaagagacaggagagaaagaagaaagatttgggatgagtcacactgggagcagagactagggagagactgatgtataaaagaatgcctggatgtcaggcacctcagaccatttgcccatttttcaacaaaaatcatccaggtcttataagatcgagaaatcaaaagtgtcattttctggctatttggaaccattgtccagtttgtattgaggccaagcggtattgcagaagaaaataaggcatttaggttttaggtcaggtgttagtcaaagggggttttaggttttgaagaacacaggctaagggagaagaagagggagtggaggctggaaggttgcccatagtgaagggggcaagcccagagaaaagagaaggtagagacatggagagaggggagatggtacttgccacccagggaaggtggtgcttgccacccagggaaggtggtacttgccacccagggaaggtgatacttgtgacccaggggaggtggtacttgtgccaaggtgaatgatcaaggcaggcatccccacagtgatcagatacctctgaaatgtgggtgaataaccaggcaggtgtcctggcagtgatttagacaccaagggaagactgttcccgagtccatgactggcaccagagttttgagttcatggataaaacgtatctcctccgtctctaccagaaagggaaagaaactgaaattaaggaagggagagattgaagggtggagggatagcaagagaggttggagaagagaataaaaagaggccgcttacccgatttaaaattggtgagatgaccttgggctggctggtctgaggacccaagaggtggatctccccatggagtgagggcgaggacaggggatgggactcccgaaggagtccccctgtcccaggtctttggcaccaaatgtcatttgcgtccatgtgaagagaccaccaaacagtctttgtgtgagcaataaagctttttaatcacctgggtgcaggctgactgagtccgaaaaggagtctgcaaagggagataggggtgggtcagttttataggactggggtaagcagtggaaagttgcagttaaaggaagttatctattgtcagcagaggagggggtcacaaggtgcatggtagggagatcataagactcattgtccagaagaagaatgtcacgaggtcgatcaatcgatcagttggggcagggcagtaacaagtcataatggaacgttgtaaggttggtcaatcagttaagacaggagctggctgtttcacctatttgtagtttttggttgcctcaggccatctggatgtacccatgcaggcttgggctaagaggcctgaaacccaccactttcccatgtcaaatctttagtagatgtacccccaagatacacattcctcggaccttcttttccatagttaaaacttcacccctgaaatgtagaaacaggaaggtttttttttaagtttcagtgcaaactcggagcaagtgtcataattttctgtctccgatgtgtagaggtgacattttctcagaactttcatgttaagctggaaaactggaaagcgagtccactttgtcattctgtcactcactcattttctcactcaacaaacatgcctcacacttatctaaatctgctaggctaaaagaggtccctggtgtctgtaactttctaattctgctagaattctagagtgagctcatgaaataaatgaaaaggatgaagaacaaagagaaaaaagactgcacgttcccttctggcgctcactcacattccctcagcctcagtttctccacatgcccctagaggtgatcattcaaggatttatgagattttagagacaacacatgaaaaagcaaagagacatcagaaagacaaggagttacttagtatttatacacaaggataagacattcagtatcgacaacacttaaagaaaattcaagagtgattttaaatttcccatttcaaatacctcctctattttgtttcctttctcttatgacatctctaaataagcttcctctaactgccagcaagtctaatttcattggatttgactgttttcaaccccaattagaggcagggttaagtacacttaaaataataatgaaatattattttgtttctcctcccagggctattggacgtttgacatggaatgttataaaaagtatagaaaagtctgggggtgagtattctggaagattccattggatagacttgtttctatgatgagtttaccccactgcacagaggatagtctcagcccagagcctcttgcgatgaagctcttgccagcctaactacaaacagagaggttttctgaaagaagaagatatgtatttgggagaagagtattagaatgggaaactgtgtgccattataagctatgtgcaaattcagggaggtaaaggaagacaaagatgttccacagaaaatatgaggaggacttcatgtggattttgaaatagttctccttcactacaaagatcagtaacaagggtgatgccacaccaaggttggacaggcagttgctgggcaggtgtccttgcagaaatatttttgtgtaaggttgggttgggctttctgcaagctggtggttttgccaagtattttgtgatagttttgttatcaggcacacaagcatgagaatccactcatcatagccttctttgatttatttgtcaaggtttttaatcacacacataggcacacagacacactgacacacacacacacacgtgtcataattttggttctcacaatgttcacactcgctattgtaaaacaactttttgagatttgtcctaccaaggatcccatatgtcaccaggtgttgaggtcttcggtctaaactaggctgagaccattgtggttaccacttttctccaagctttggtggcccagggactcccagcatcacgttctgtccagtgtctgcctattcccctcttctttttttcttcccttgatgcccttttatcacatgcattgtctcagacccttcgaatatgtgctcataaatgcatggcatcatctccttcccacatcgattcactttcaattaaaagccaaaactctttcatttcaactttggatttaacatgcttttgaaagaagggttgagaaatatagagaaacagattgggaaaccatgctctgctgtttcttttttttaaactttctatgtaagtgtggaatttttcattctgttttattattaactttaagccaagactttttaatagaaggatatataaatacatctttgtctatacatttctgctgaatttgaagagatgctgaatattcttaaaccattgtgttccctggtgggctgatggactgtgattttataaggtggcctcagccaactgcagcagctgttccctgtcagaggggctagaggtttggcaagagcggtggaagaggtgcagtggtgtgttcgttcactagaagcattagggagaaggttttgcctgtttgtatttcatcttctctcatcaagtcctcagaaaccacagtgctgtctgcagggtgctgtggatctggcatggcccatacaggcaacatgactgagtagaaaggacacacagctctggatgtccttgggccccacagcaactgcccttgaaacatttagtccttgtgagcatttgatgatttacttgccttcaattttccatggacctaatactctttataaagggaaatattttaaacctatgaaacattgtggagaatggcatgggaaatacccatgtatgcaccacccagcttaacaaatgctctcctgtcatttctaaccacaatctctttgaagagctcttttgtctttcaatctctcttccctgtttggcccacattacccttcatcgtatgaagacttggatggctcctgtgtcagactcttgctgtgagttatacctaatgaactagaacttaagattactgtgtattgtacatctagaggattatgtaatgtccggatcaaagtctggcttcctgggtttggctccagctgtagcataaggctgttgatgtttaatcaactctgttttctccacacagtatttatgactgtcaacagcctatgctggctatcacagatcccgacatgatcaaaacagtgctagtgaaagaatgttattctgtcttcacaaaccggagggtaagcatccattttttgaaattaaaatactcattgattgattaaatttttattttaaaattcttatatattcatagacagttgcctaaaaactgtgcaggaaggttccatgtacacttcatcctgcccatcccccatggtaacatcttgcaatcttgcataactataaatacagtatattcacattactgcagtacaggaaattaacattgatacagttcacagagtttattcagatttcaccagttttatgtgccctcatttgtgtgggtagttttttgtttttgtttttgtttgttgtttgttgtttgtttttcggactgagtcacactctgtcacccaaatgggagtacagtggtgtggtcttggctcactgcaacctccacctccagggttcaagtgattcttctgcctccacctcccgagtagctgggactacaagttgcaccaccacgccctactaatttttgtatttttagtagagacgaggtttcaccttattggccaggctggtcttgagtgtgtgggtagttctatgcaaatttatcacatttgtagatttgtgcaatgaccagcatgatcaagatgcagacccattccatctccgtatggctccctgctactatcctacagtcacgagtgtttttctctgagagggtctttatcagggaaaactttttttattttgaggaggccaatgtattaatatttttttatggattgtgcttttggtgtcaagtctgaaagttctttgcctagccctccttcctatattgccaatttttctaaaagtcataaagtttaatgctttactaaatgtaactctactatctattttgtgttattttttgtataaggtatgagatttagatcaacgttcattttttgtggcttgtagttgtccagttgttccaaagccatttttggaaatgtgggcatattgttaaaaattaattgggcatgtttctttgcatctttcatttgctattctgtcccattgatcactgtgtttattcctccatcaacaacaaactggtgactctaatacctgtacagtaactcttagcatcatgtagagtgattcttcccacttttatggatgtatttttttagatttgttttagctcttcctggtcctctgcttttccataaaaattcagaatgagtctctcagtgtctataaataaacatgctgttattttaacaagaattgaattaaatgtatagatcaatttagggaaagtctttatcttcactatgtttggtctttcaattcatgaacatagtatgcctctccatttccttagattttctctgattgcttttagcaatttgtagttttcagcatagagatcctgtgcatgttttgttggatttacagctaaagtatttcatttttgttggagtgattgtaaatgatattatgtttttcttgtattttcagatattgattgttggtacatagaaacatgcttggcttttgtttgttgatcttgtatcatagaaccttgccgagctgacttagtatttctagaagtctttttgtatattcttgagattttatacattgacaattatgtcacttgaaaatagagacaattcttttatttcctttccaatctgtatgccttttaattctttttcccagtataatgtcaaataaatgtgttgaatttttgaattgttcctaatattaggaaggaagcatttggtctttcatcatcaagaatgatttagatgaagtgggtttttttgtagattctctttatcaaatggaggaattttctctccctagtttgctgaatttttaacataaaagagtactgtaagtactcattataaaacaaaatatggctgtggaagatgaaagagagtttcaagcatgctggcttgataggccagatccaagctggcaaaaataattatctctttcttctttttttctatccatggaataaaaaattaagaggaaagaatgttaatagaatcgcattatttcttcaaaatacgttgtgagttttaaaagtattacctaccttttttattatactttttttagggtacatgtgcacaacgtgcaggtttgttacatatgtatgcatgtgccatgttggtgtgctgtactcattaactcatcatttaacattaggtataactcctaatgctatccttcccccctctccccaccccacaacaggccccagtgtgtgatgttccccttcctgtgtccatgtgttctcattgtatatttttttaaatctaccacatcaaggcacctctttttcatgttgcccatggtttaggtgaacataaagacagagctcgtctgaggcaacatacagtccaacaaagccacctgcctctctgtctccactctctctctacactgcacgcgtgctaggtgttgatcctgtctattccagtggaagaacaggttccgtaccatgtggagaatttgcatgtaaaaggagactgggatatacaggctggagaccacatcaggtggctgggcatgtgggataaatcctattgagcatctgtcatagggcctgtcacttagtagacagtcactaaatatttgttaaatacatgatgcctgtttaacacattttctacaaccatggagacctccacaactgatgtaggacaaaatctttctgctttgaactctagcctttcgggccagtgggatttatgaaaaatgccatctctatagctgaggatgaagaatggaagagaatacgatcattgctgtctccaacattcaccagcggaaaactcaaggaggtatgaaaataacttgggttttaattagaaacttaaagaatgaatcaggtggggacaggtagaaagtaagatcagagttcctttccgaggagtagtctgctgaatttgagcttcctaaaaatagtctttttatgtacagaaaacacatcataaaattcattatacaatgtcacttattgttccatgccaggcaaagtcatgtccttctgggacttatgtctgcacatttaactatgggtggtgttgtgttttgtgcttagatggtccctatcattgcccagtatggagatgtgttggtgagaaatctgaggcgggaagcagagacaggcaagcctgtcaccttgaaacagtaagtaggagcacagccatggggttctgagctgtcatgagcccctccagctgcctgctatggagctgatactcccgctgttgggttattccagtgaccagacaaaaggagggctgtggtaatgcaacttcaatgggtctcccaagatggggcagctccgatgaggaggtggggcagctggaggaaaaggatcttctcccctgtgcacagaggtcagggtttacatatctgttaaattgtcaccttggatattctggaggactaaatacatcctttagggggaaaagtgtgattgtatcaaagttttaagcatggagtgtatgggatggtggaaggggaaggcacttggtatctgttggttggcagtgagtagggtgggaaagttataatggagaacttagaataactttgatcatttcatgttttttttctgagggtatcagtagaatactaaatattaaacattcccaccatttctttttcctccagtctcaaagagagagggtggtaaaaacgctataggtggggcaagcctattatttgctgtctacacttatgcaggaacaacaggtgtaatctgagcctgtcctgggcagacaggggatatgtggtcactcactatagaagtttccaaatcaaattttgagagttttttttaaccaggacatcatttgtcattatattttacaaaaataattctgccatcagggcaacctcagctcaccacagctggggatagtggaattttccaaagcttgagcagggagtatagagaataaggatgatatttctaggagctcaggacatggtactgttgctttgtaaagtgctgaagaggaatcggctctgggcatagagtctgtagtcaggcaatgtcacctgtcttgagccccttagaaagagtgaatttttctactcttgttctgctgaagcacagtgcttacccatcttgtatcatccacaattaacacatgctactgcagttgtctgatagtggatctctgtctttctatgactaggctccttgacctcagaggtaagtctaactcagttgagtgtctccatcacccccagcggagagccagctgtgtcactgacacctgataatcaccttctgagggagtgtgatgggagatgctccagtaaatagttctgaaagtctgtggctgtttgtctgtcttgactggacatgtggatttcctgctgcacgcatagaggaaggatggtaaagaggtgctgattttaattttccacatctttctccactcagcgtctttggggcctacagcatggatgtgatcactagcacatcatttggagtgagcatcgactctctcaacaatccacaagacccctttgtggaaaacaccaagaagcttttaagatttaatccattagatccattcgttctctcaataagtatgtggactactatttccttttctctccctctctcttaaaaataactgctttattgagatgtaaatcaccatgtaattcatccacttaaaatgtacagtttaatggtttgtagtacatttgaagatatgtacgaccatcaccattgtaaactttaaaacacttctgtcattctagaaacctcatacatgtttagctatcaaccccctgccagaaatcctgttgtcgtatataaccactagtcaactttctgcatctatagatttgcctattctggacacttcatagaaatgatattaatttttcagggtttttttaattctctagttcatgaatttgtactttagtctgtattattttctttcttctgctggcttcaggcttagtttgcccttctccgtttactgtgttgtggcatgaatgtagattattgatttgtgggtttttttcctctaaatttagacattacaactataaatttccctctgggcacttgtttgctaaataacatgacattctggcctatcacatcttaatttttgctcagctcaaaacagtttctatttgcccttttaatttctacttcaacttattggttgcttaaaagtttattgtttaacttccacgtatgtgtgagtttcccaattttcgttaccttattgattttagctttatcctatgataggtgacagagatacactgtgttatttctatctgatttcttgaagagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaaggtaaaacgtggtggtagttataggaggatgtttagttttcataattttttagaaatatacatatgatcggtgcacttccctgtatgtttttagagaaagattttaacataaagagtacttatgtttagagcaagataattcatttggtaggaatgcagaaagtggagtttgaggaaggagatatgagaatgagtcagagagagcacttaaaatttgatatcaggcacaagaattagtatgccatgacataaatattattcagataaaaccttatcacagcacttcccttcaataaattgtcaaaggataaacattactgtttggaaatacattttattggtattatgctttctctagatcatagattggtaaagagtcatttcaagtacaaggctattattttacacattctccaacaaaaggtcctatcaggccacctgctgaagtgtagtgtgtgttacatttgagccctctgacagcctcgagtgaacagaggtcttctctgggaattgaggctgcaaggctggctaactcagctttgccttcatgagccctggagtccagccaaaagatatctgcaggtcaggggggcaagaaggggtaacccaggtgtcactgaagattgtacagatttggggaatgttgcagtatttgaaagtgctcccaccaaagctgctgacaagttctggaaatgtcaggagaataatctttgtggacattggtgatgaagaagacagaagaataaaaggcccaggacttcttcatgggtatgcagttaggaccagggaaaagaccaaaaagcaattgaacattttagccagatttgtttcaggaaaacatcctgctttccaaggatttagatggatattccttttcactggtgactcaggcaacacccatcagatttctggtctccaaggggctatattctcagaagggaggttgaggactgcacttctgattaacttctgacttcacgagtcactttctgtcaataaaatttctctttttgcttctagcaccgagtggatttccttcagctgatgattgactctcagaattcaaaagactctgagacccacaaaggtaacaaaagagtgcttctgagggctactggtggggcactcagagggaaggttttgttctgaaaatgtgcaggaagtattccaggtagatgagaatttctgccacatagcagaatgacacaggtttggatgttaaaatggtagctggaggcaacttctagaggcatgcaggcatagatagccatgttctaagcttaaagggcaaccctaaggaaaactggcatgccaggaagagtcagcagtctgtggatcacctacataagatcaaatgccagttctcagcctcctccagatccacagaattaaagtttcttcctggaaatttattaggtttctgcaaaaataattgcaatttttgtgattgctttcaatggcaaaaaccgcaattacttttgcagcaacttaatgcatctaacacctaatcaggagccatgctatccaaataagggcgattttaactggcaatttttggtgaaagtgtgttcaccaggttaatcaactatgaagttattttttcctttgcaatggataagtaactttttggaaaacctctgagactgtgtaaatatcctttgtcttcagtctttcacctaccagttttacaacccatgtacgatttttactgaagtcattgttactatgagtggcaaaatgatggccatgttcagtttcaagccaccaagatttggcaatcatgtcacaaaattcctgaatatttaatcattggttctagagagcaggagtaggctgactttggcatacagatttaaatatgtccatgtctacatctacttctgtctgtctgtctatctatctatcatctgtccatcaatcatctatttatctacttactgattatctagctatcatctctctatctatcccaatacaacttgctgtgataaaggaaatagcctactgttttagtgtttcatctagaaatcactagacacatatagctattgagcactgcacatgtggctagtgccactgatgaaaaattttaagttgtatttaagtttaattgaataaaatttgattttaaatagccacatgtcaatagtggctaccacattggacagcagagctctaaactttgagattatagtttggtttcacatcagtatcatcaggttcatggtaacagaatacaattattagatagttgaatttacccacaactgcatcacagaaatcttcactggtaaatcacagctctgttgacatttctcacactcctttcgtattggttttggtggtgagttacatggttggaacaggcactatatttatttctgtgttcccggtctctaaatgtcctaatccagtcctgatcaaacagaccagtgatgggccatcctgagcttctctcaggaaaaaaatcaagagaggggccaacttgcaatcacaagagcttataccattttaatgccattcatcagactgcaatcaatcaccactcatctagctttttgtccatcttcagttgctgtacatcctgagatagtcaattctgagacctatagcctgggtctattacctggtgcctctcaaagatataatccatacttctcaacctgggctatgcacacaaattaccacatcttgtgaaattcagacttgaatcagtagttcaatggtggggtttgagattttgcatttctgtttttgttgttgttgttgttgttttgttttgttttgagacagagttttcgctcttgttgcccaggctggagtgcaatggcatgatctcagctcaccacaacctcagcctcccagattcaagcgattattctgcctcagcctcccaagtagctgggattacaggcatgcgtcaccatgcctgggtaattttgtatttttagtagagaaggggtttctccatgttggttaggctggtcttgaactcctgacctcgggtgatccacccaccttggcctcccaaagtgatgggattacaggtgtgtgccaccatgcccagcctttgcatttctaataaggtcacagatgcttatgatccacggaccacactttgagtagcaagaggtggtctgtattccaatattggtctcttaagttccctcaaacatatctaaaggaaaggtcctttaattttccatacatctagccattaatgttgcaaattctctcaaagtttgtcaaggtatattgtagctaaaatgaattacatttttcttgggagagaagactaccccatattaatttacaataaagtacttttaggatcattcaaggagcacaccatgacactgagtatgttatgcagaaatgttctctctggaaattacccagctgtgaaggtggcagggatggcacgaggaggagcggatggtctacgttcttgaagacattgggggaaaactggattaaaatgatttgccttgttctggctctgtaagacacacatcagagtgaaaccacccccagtgagactctgaattgcttttctattttttcccctggggatttgaaggttccacttagatttcttttcatctaaactgtgatgccctacattgacctgatttacctaaaatgtcttttctctcctttcagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggtgagtggacagtacatggagaaggagggaggaggtgaagccttagcaaagatgcttcctcaccacttcccaggagaatttttataaaaagcataatcatgattgtttcattcacaatatgtaggaaggctctcaaaataaaaagaaggaagcatagggaatggttgctattggcagaagtataagatctttgtaaaacagtcctctccctggttcatctgctttctgttaccacaataatgctaagtaaaaaaacatccaaaaacctccctggcatttaacaatatgcatattgctcacacgtcttgatagtgagctctgctgatattggcaggacttgctctggtctggctgtgatctgatggagcctggccctgggtgcgctgtgcaggttgactcagctctgccccacatgtgtctcatgtttcagtcaggtaaccactggtgaagaagcaagctaggaaccagggtatctgacttctgagctaaactcttaaactctataatattgcctttcaaatataacactaagtactaggtgcctatcaaccacactgttttcagacctctgccaaaacttggattctttgtgctatgaagagacatggcttttgggctggtctttgtgtggcagtgaggtgagcacaaagggatgttcttcagagattacagtccagccctgaagcaacaactaggagactgtttcagcaagtgaggacagggctgtgtggggttctatccttttcataactttgcctggcactgaaatcacatgctctgataacatccaccagaactttcttttgtcatatttgggatagaaagggactagtttttcctcaaattattgatagagattttatataatatagtgtttctctccacattttatgtatataacaaaagccctgcttttgtgtatatatgcatatatatatatatacacacacacacacatatatataatacaaatcctgctttgtaactgtttttgtttgtatatataacaaaaagagttatgaaccagaagtttggccaataatccttgtcgcacagagaatttgctttttctatctgttttcacttccttggttacagacgtgtaacctcttttttgaatggtgacaatcactttgtcatattttatttgatgctagtggtcatagcctattagtcatgtttgcttccatgagaaagaaaaaccactacatggttatgctaaggatttcagtcattggggttagagccttcccgaatgtctcctgctttcataactcctccacacatcttagtgggccattgagcacatcaaagggcatgacagttattaaaatactttatgaatgctacaatcctttgccagtatgagttgttctctggaacttctaacagttcaacagtactacatggactgagttaaaagttaattcaaaaatctcaatttatccaaatctgtttctttcttttcaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggagagagcctgagaagttcctccctgaaaggtaggaggcccctgggaagggagccctccctgaaccagcctggttcaagcatattctgcctctctacaggacagtctgggcttgtacaatcgtttgcttgtctttttatgtttaaaaggttttttcaaatcatgaaattgatcattgtcacactttacaaaccacagactagataaaagaaaactatagccagtcacagtcccagcaacttaagatgaaggtcctcaattatgtccttatgggtcataagtgtccaaaatgtaaggactcttttaaaaacacatgatcacaatgctattattatgtcccacaaatgaatattttttcctgaatatactcaaatcttcaggaatcaaatttgaataaaaaacatgcgtctaatcttcaaagaatttataggttagtgcaacagatagacaaagaaagcagtgatgacactgctttccatcaatacagtagcatcatatgcctgtgtaaattatctgacttaaactattctatggaggtgtgggggagaaagaaggagagatggagattagaagaaggaggagaaggaggagagaaggaggggtaagacaaggtagggaggagaaggaggagaattagaaaaacaagagacgagaggagaaggaaagtgcaaaataacaattttgaagtagtgcaagacaatttcttctccttcctcatgaccaacataagggtgacttgaggcaggaatctacttttctgtcagtcattctcatcacttatgtgccttttgtagtgtgaacacatcaccatcctgactataatttgagtgtttagaaataaatatactttgcaacagtatttatctcctctcaacaagactgaaagctcctataatgtaaggagagtagaaaggatctgtaccttacaattctcatagcaaaatatgcatagcaggatttcagtgactagcccacaaaagtatcctgtgtactgctagtagaggggtgggccctaagtaagaaaccctaacatgtaactcttagaggtattatgtctttaacttttaaaatatctaccaatatggaaccaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacaggtcagtcaattttctgcattaataatgttttattaacaattattttaactgaatggtctatatatttaaaaaagaatacactcacttaatcttttaataatttgttctatgggccaaggaatctatttggacccatctatgatctttaagggtgcttcagttctggagttcaaaagctgtagcattaaaaacatcatgcaatgtcaatgtagactagcatgacatgattatctacagtctccttgaacttgagcaaaattaaattcagtttcaagtcaattggaaagatggggaagtattttgcacaatcatgaggtgcacttattatcttgttttgacttttgaatgatgctcttccttcccagaacttgtagaagttttctcatgacagtggctcccaaccactagctgtacattggaatcaccagggagctttaaaaattcatgatgcctggaacatctcagaaattctaaactaatttgcccagagtgtggctttaaaagctcccccattgcttctcatgtgaagccaaggtggaaaatgactaatttaaggtagttctattggatacgaaggactaccacagtccaaggccatccttactgacctcaccttccaggtgcctagctccaaccaactgggctccttttcaactcaattataactctgctaatcttctttcctttcttctcctcattctgttcttatctttcaagtcctagttcaattcccaagcccctccaaggtgtcttcttgacctagtccagggctcatttactcctctgctctgttattagttactggaggctattatcatataatttcataatttgccattaaatcattgagttttgttctctatattttctctttatctaagaatgtcttcccccctccattaacaatatcttctcattttattccatttaaaatatcccagtggtgccttgcaagtgacctcatctaactcaagcatttggtcatttggtaaatgtttaaggagtgatatgcagtcgattggtttgcatacaaatattaagttttttaatgtgaacatttagcaaatgacattcatgtatttgcatgtgtgtgtgcttgcacatgtgcacatgcatgtctgtctgcagggaaaatatattcatgccttttgaaaatttttaaataatgtgttatatttatagaaagatttggaaccttttctctgaagaagttaaagaacagatgtcattgattcatattaagcaagaccctataaatcttatttctaggtctcatgtatttattaagcaactccacaccttaagcaggctttctacatagaagaggaagaagatagagatggtttccatattattttcatattccacattatttgtggctttaggccagctatgtagctatcctgtatgtgtgctcagacaggagactcagccctgagagaaggcggtcctctggcacacctaggatggggaaggtactcccttggaagtcccaagctggcacttctggatctccatggcaattttcttgcccatcactccatggagatcagaatatcactctattgtgtcccctcaacactgaaggagtgtctcaataagaaaagttgagtcaaaacactgtaggaattgagaggttccccacttgcactacccttgtaaaccaagagaagatgttaaaaaataaaacgataatgcttcctgaaggtgtcttcccatctttacactagatgggttcaattgagaggaattactggactgtggaagttgaagactgtccacataattaaaatgtacaatagctactcaggattaccttgcaagtttcaacatacacaaaattaacttcataagatggtttaaaaagtttaccgttatacctaataatctggtttaaatttttaaaactcatccattttcgttaaaatttaaatcaaaaaagaacacgggttcccatgaatttgtctcaggtcaaacctcacacagaataggtgctccatgaatattttgttaaatgatagatgatgaatgttctcactatccaatcttcacacatcttatagagtaagtataacgaatccaagatttatagtgctgaaagtagtttttatatgtttacaaagcattattgtcagtaatttttttttactttgatgctatactttctacttttgctttatttaatgcttctcaatatgctcgtttaactgttgcagatccccctgaaattacgctttggaggacttcttctaacagaaaaacccattgttctaaaggctgagtcaagggatgagaccgtaagtggagcctgatttccctaaggacttctggtttgctcttcaagaaagctgtgccccagaacaccagagacctcaaattactttacaaatagaaccctgaaatgaagacgggcttcatccaatgtgctgcataaataatcggggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaactgaatgactgagaaccaacaactaaatattttgatcattgtaatcactgttggtgtgggaactggagtgcagtggtgcaatcttggctcactgcgagctctgcctcccaggttcacgccattctcctgcctcaacctcctgagtagctgggattacaggtgcctgccaccacgcccggctaatttttctatttttagtacagacggagtttcactgtgttagccaggatgctctcgatctcctgaccttatgatccacctgcctgggcctcccaaagtgctgggattacaggcatgagccacggtgcccagcccaatttgattattaacataggtgagagttaacccactatgactttgcccattgtttagaaagaatattcatagtttaattatgacatttttgatgagacacagtggctcacacctgtaatcccagcactttgggaggccaaggcaggcagatcatctgaggccaggagttcaagaccagcctgaccaacatagtgaagccccctttctactaaaaatacaaaaattagctaggtatggtggcacacgcctgtaatctcagctacccaggaggctgaggcaggggaattgcttgaacctgggaggtggaggctgcagtgagccaagatcatgccactgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattggacaacaaggctgaaactactcatttcttttcttttcctatttcttcctttattttccctttctgaataatttagccctagagccattaggtgggtggcagccagatggtggccacacattaaggtagagaagagagtcatggtggttccaagtcagagaccaagtaggatgaggacaaactgggtgttcatgtggaaacagcctgcctgggtgtgggagtccaagcaagcagagaaggggttcatagagaggtgtggcctacaagagcagccagagcctaaatagagcatggagaacccatgtgaggtcaggagggcatccatgagtgggaagtgatgggtgaggtttggttacataaaggggatttatcaaagaagtaaatatattaaggatgatagaagccaggcttctcatctttgaagaacggagtcatggattcagaaagggagaaaactagcatgaatcctatgaaattagattggaatggatgtattcgtgtatattcatacccttctagatggatagatgggtagataggtgatagataacagatatacgatagatatatagatagatgaaatgtatacatgtgtttgtgtgtgtgtacaaaaaaaaccatatatttcctacttctcttcactgataggtctaggtaacaatgacatttcaatagcaatgagcacacttagcgcccaagtcttggcttatgaataccatattccatggaaaggaaccagagctctttagagaaatgcctgattccagggccagggttaagaaggttcaagacaagcctaggacacattttgtgccaggaagcaagaaaatgttcaaatgatttccaagtaatgtttggaaatgatatttgaaaaagaccctccaaatgataactccaaattattttcaaatgatatttgcaaaaacctaaagactccaccaaggaactactagaactgataaaatattcagtaaagttgcagttgcaggatacaaaatcaacatacaaaaattagtagcatttctatatgccaatagtgaacaatttggcaaaaataaaaaagtaatcccatttacaatagccacaaataaaactaaatacctaagaattaacttaatcaaagaagagagagatctctataatgaatactgtaaaacactgatgaaggaaattgaagaagacacaaaaacagaaggatattccatgtttacatattgtaagaatcaatattgttaaaactgtccacactacccaaagcaatgtacagattcaatgcaatccctcaaaataccaattacattcttcaaagaaatagaggaaaaaattctaacatttctatagaaccacaaaatacccagaatagccaaagctatcttcagcaaaaagaacaaaactggagaaatcttattacctgacttcaaattatactacaggggtataataaccaaaacagtatggtgtttgtataaaaacagacacattgaccaatgaaatagaatagagcacccagaaacaagtccacacacctggagtgaactcatttttgacaatgttttcaagaacatacactggggaaaagacggtctcctctggtgctgggaaagctggatatcaatatgcagaagaatgaaactagacccctatatctcaccagacacaaaaatcaaatcaaggtggatgaaagactgaaatctggccaaacacggtggctcatgcctgtgatcccagcactttgagaggctgaggcagacagatcacttgaggtcaggagttcaagaccagcctggccaataaggtgaaaccctatctctaccaaaaaatacaaaagttagctgggcatggtggtgcatgcctgtagtcccagctactcaggaggctgaggtgggagaatcacttggacccatgaggcataggtggcagtgagccaagatcataccaatgcatgccagcctgggcaacagagtaagactctggttccaaaaaaaaaaaaaaagactgaaatctaagatctcaaatgatgaaactgctacaggaaacattgtggaaactcttcaggacattggtctgaacaaaaaatgctgaagtaataccccacaagcacaggcaaccaatgcaaaaatggacaaatggaatcacatcaagttaaaaagtttctgtgctgcaaagaaagcaatcaacaaagtgaagacgcaaaccacagaatgggagaaaatattttcaaacactctgacaacagattaacatccagaatatacacagagcacaaacaactctttggaaaaaattcaataatcctaataatcaaaaaatgggcaaaatatttatacagacatttctcaaaagaagaaatacaaatgccacatagttatatgaaaatgtgctcaacatcattgatcatcagagaaatgcaaatcaaaactacaatgtcatctctccccagctaaaatggttttaatccaaaagacaggcaataacaaatgccagtgagaatgtggagaaaagggaattctcgtacactgttggtgtaaattattacaaccactatagagaacagtttggaggttcctcaaaacattaaaatggacctatcataagatccagaaatcccggtgctgggtataaaccaggaagaaaggaaatccatatattgaagagatatcttcattcccatgttcccaatagctgctattcacaaatgccaagatttggaagcaacctacatgtccatcaacagatgaatgggtaaagagagtacttcacttatgcacaatggagtacaattcagccatgaaaaaagcatgagatcctgtcctttataataacgtggctggaactgcaggtcattatgttaggtaaaataagccaggcacacaaagacagacattgcatgttctcacttatttgtgggatctacaaatcaaaacaattgagctaatgtctgggtcttagtcaattttgtaccctaagtacagggagcacagccattagaatacatgatgaatgctttaatacaggaatgaataggtgagaggcacagggtggttgggtgttcttctgatacatagtatcttccttgacacattcagtacaactctcaacaggtaagtctcttcatgtatgttaccttctgaggaattaagtggcagaacatgccttctattattttcctttgcagaacaagaccaattgcattagttgggaaacagtgctggctgcatctgagccccaagcaaccattagtctattgctatcaccacagactcagaggggatgacacacaggggcccagcaatctcacccaagtcaactccaccaacatttctggtcacccaccatgtgtacagtaccctgctagggtccagggtcatgaaagtaaataataccagactgtgcccttgaggaactcacctctgctaagggaaacaggcacagaaacccacaagggtggtagagaggaaataggacaataggactgtgtgagggggataggaggcacccagaggaggaaatggttacatctgtgtgaggaggttggtaaggaaagactttaacagaaggggtctgtctggctgggcgtgcaaggatgtgtaggagtcatctagggggcacaagtacactccaggcagagggaattgcatgggtaaagatctgcagttgtggcttgtggggatggatttcaagtattctggaatgaagacagccatggaaacaagggcaggtgagaggatatttaagaggcttcatgccaatggctccacttcagtttctgataagaactcaggttccgtggactccctgataaaactgattaagttgtttatgattccccatagaatatgaactcaaaggaggtaagcaaaggggtgtgtgcgattctttgctactggctgcagctgcagccccgcctccttctccagcacataaacatttcagcagcttgacctaagactgctgtgcagggcagggatgctccaggcagacagcccagcaaacaacagcacacagctgaaagtaagactcagaggagacagttgaagaaggcaagtggcgatggacctcatcccaaatttggcggtggaaacctggcttctcctggctgtcagccttgtgctcctctatctgtcagtaactgtccagattcctctcctctgttaacttggacttggggtgctactcaggcccctgttccctcatctgttttaaagatcaaaagagatgttcaaggaggagtagcttcttggatgctacaaacacatagaggttattattgatcttatgcagatttatgaagaaataaataagcatttgtcccagccaccttctaattttggtgactaggagggtttggggacagcatttgttagtgggaatgatttgattagcttagatttgacctatactaatcaatgaaaatgaaaacccagcaaaggcagattacaaactgctgaacaagacgagaagtgtgatcctcatccccttcccaggttctcgggattctgggggcaggagggagcagcttgggtttttgtctcattaccttcattttctgggttctctgtctgctggaagagatgtgtagaagtttttcctctgtggacctggtggttcctgctcccctaacttccaccccaggatatcatttacataacacaccggggaacaccaagacttcacgggaagctgtcccccggctcttccctctttcctgtgccatgtcccaaaacatcccctccctcctatgactcactcctccaccctgtcatacacagaactatttaccttgcaatgattaatctccagagcaaaggagacttggaggaagttttgaagatttattctttgctttaatctttttcctcccgtctctgggaggctagcattaatatagagctttgtttctcagctaatgggaatctgctagcagcctgaaaaggcaggagctgtgaaagccaatttggattttacacattttttcccctttgtgttacagtaaaggaggatgaaccctctcactggtgggattcctggcatcctagagcaggtggagagaagagttactttccactgtggttagtggaggctccacctgtcccattaacttctacctcaatttgacttttaagagcaggcaacaacaatgacatgaaaataggaaatataaacttcattttaattttttcacagaaagcttaggaattcagtgagttgtggcaacatggtttccattgtctaacattttaaaatgaattgatatggtttaaattcattcatttttaaatcagaattttttggagatggaatatttccagcatgttccttctggatgatgaaagagggctgttagttcagtatttgtgacaataaatgtgtgtaaaataacatcacctctccagaataatgtcaggaatatgagtctaaagcatgaatgtatatcgctaagacaagactgcgatatacatatttatgtatatctttttatatttaaaaagatatgtctttttaaatatacatgcctgacagtttattttaatacctcctttttgaatatacctgcttagcaggttatcttaaactgtcaggcaggggagtaagcaatactgtgagctagtgatgatagcaaaggcatccacgtaggatccgtatgaagtaagaaaatattcctcagctctcagggtagaactccaaagagatattcatgggtcctggccccacagtggaggtcactcaaaaggcaaacaggttggcatctcatctgcttcaagcctggacacagggacatcaaatgtgtcactgtgtgcgtggtctgccatgttgtggggcggtcactacagactcgggcagccaggcagacaatgccttagccttagacaatgctggtgcagcccaggagtcagaaactgtagtgtagaccatgccctccttaggccaacacaattacgtgcaatagatgactggcttttctgttagcctcttcattggaaccaaaagtggtattactctaccagaggggagctagaaagaaactaaacagtttgcccagcacagcctctgccttgacatggaaccatgtgagtctagacactcacctagatctttccttgggggacagtgctgctgacagattaactcaatagtttgtcctgacctgagagatcacgtaacttctagaaagtgtagaagcagagattagtgtcattgatttgccatagctgtgacaataaaagaaggaacaggagtagaaaacccaaggccaccctggtttcagtagatggtgcacacatttccactaactattctggggcaaggatccaaatgcactatatgctgcctctgctgggatctccaaacacgaccctccatgccatttctcagttgtattttaccacatattatcagagtcactggatttgtacagaatgtttggaacctatactgccttaagtgctacccattatagaagagaaaacaaggtcttcattcaactgtctggaacattttatgtttacttatgtggaatactgtaccttttgctatcaacaggaaggtacctggacattagaaggtgcctgtctttcagctgaaagcacacatgacgcatatggatccatttatatacaccatacttttcagccacattttcctaatttgcctctctgggaccaaccttgtgggactagcagattcacggttgagttgatggctggtgatgtctgccatcagcctttcttcttcctccagtcttccacccctcagtaacatcagactgggaaggtcttcagatatccagaaccctcagttgggggagtccatacatgacccatcaaagatgagttgcaagcaggcctgccatagggagcagcagccttaatgggttttcctacagagatacttgatgtgcagaggcaataaactgactgctttgtgattgatcaccttgaaaaaagtgagcatatctgggtgtattagtcctttcctacatcgctgtaaagaaatacctgaggctgggtaatttataaataaaagagatttaattggctcatggttctacaggccctacaggaagcatagcgacttctgcctctagggagccctcaggaaatgttcaatcatggcagagggtgaaggagaagtaggcagatattacatggctggagcagaagcaagagagggtggggaggaggtgccacacacttataagccaccacatctcataaaaactcattgtcacgaggaaacacccaaagggggttggtgtgaaaccaggagaaactgcccctaagatacaatcgccttccatcaggccccaccaccagcattggggattacatttccacatgagatttgcgtaggggcagattcagaccatatcactggcagtgtgcttattatcaggtgaataccaccagttggaaggctagattccacaagaggaggaatgtcctggaaattggttttttaagttgtggatcttctgcacactgtcattcagggaaatatgagttaatcatcctccccaatagcgcaaatcaaccagatcatctggccacagagactgaggtgtagctgaaaggtgcttgcatttctacgaggccaatggaagccttcagcacagttgtcaatctgtagaaataaggactctgtgactcctctgacacccctctatgaatgacagtttaagaagggccagatcctaaaatagggtcagagcttagagggaaaggaaagtataaaagactcttcacaaattctaaagacatggtcaccataggctctcagtgaccctctgtgactgagtggatgcagtgatgcaaaatctcatcatcactgcagaagagaaaaaaaaaaaaagtcaccctttctgcctaggatgagaatccccaaatcagggaagagtccacttactaaatagacataaggaaatgaagtgccctggaagaattccttcctgaacctctgaggagcactcacgtttgaggacatttatcaagtattcattccaggattgggaccataaagacttctgctgctttcgactaatcattgtgactttttggtgtctcatggtggagacgggaaaggacttgatgtacaaatataatcattgctgtcagagttactgttatcatttattgccttaatgttacctccttctcttgagcattccagttcctcagtcagtgacttaccagcccccatatctataaagtcacaatccctgagacctgatttctgattcagtttgtagatatggagcccattcacatggactttttaagaagcttggcattccagggcccacacctctgctttttttgggaactactttgtcctaccatcaggtgagtgtttttgagctcactctttggcttcttatgattggagagagcagcttagttccatcagtaaaactgcttctcctcaggaggaaggtctgaggttttacactttcagaaacagtgtataggcatcatccagagcatggcaaggtttaccccgggactctcttgctaactctcaggaacctcaggtttgcctcagttgaacagtccaaatctcaggtatatcggcaacctgatgttcagaacttgatgtgcagactttgtgagcaccataaagaacatttttcttttgccccatgtaggttcccaggaaggtacagtcatatttagttagtattaagagtaggaaaaggagcccccatttgtggcttgctatctgtgtacatgagagtcaaactttcctctctatagcaagagctcaggagtagcctttttcccctacctcctggacagctttgaaactcactttattagggagctcaagtatttaccattgggtcattcgcacttgcttgaatcctctccaaaaaatgctaaatcccctgaaggtatttccatggctctaccccagctcttactccccatgacatcttttgcagctttgggagtcagagcaaaggtgttctgctttacttcttttatttcaaaggctgcaccttatgggtgagtctgagcagggagtggatataactgagatgagatagtggttatctatcaaactcagatatttaagcataaaatgaatttgtggttttttttttaaacaaaggcagaatcatatgcaaaatcactagaaaggtgataatttgatgaaattattaaatatttaattttgctgaataaaatgtcatatgtgccacatggactgtgaactttggtcgagcctttgtgcctaacctggtctgatgctctgtctagggcctggcctctggatggaaaattatgagcttatctccacagggccagcagcagcagtagtcagctctgtggcttagatcatctttcccgcatacctgaggcttgtttccctgattccaattcttccaagtgagggttttgttgtctaattactgcccaggaatttcatatttttccctttgcaaaagcaataatttccccgccaccttttctaggtcagttctttagtagatgtaccccccaagataaacattcctgggatctttgtttgcacaggtaaaacatcaaccctgaaatgtagaaaacaggaaagtttgtttttcagtttcagtgaaaacgctgagcaagtgttgtaatttgctgtgtccaatgtgtagaggggacattttctcagaacttccatgttaagctggaaaactggaaagtgagtccactttgtcattctgtcactcactccttttctcactcaacaacatgcctcagacttatctaaatctgctagactaaaagaggtccctgatgtctgtaacttcctaattctgctagaattctagagcgagctgatgaaataaatgaaaaggatgatgaacagagataaaagactgtgcattcccttctgacactcactctctttccctcagcctcagtttccccatgtgcccctggaggtgatcattcaaggatttatgagattttagagacaatacatgaaaaagcaaaaaggcatcagaaagacaaggagttacctagtttacacacaatgataagtcattcagtatctacagcactttgagaaaattcaagagtgattttaaatttcccatttcaaatacctcctctgttttctctcctttcccttatgatgtctccaaataagattcctctaactgccagcaagtctgatttcattggattcaactgttttcagccccaattagacgcagggttaagtatatttgaaatattaatcaagggaagcatttccaagatggccgaataggaacagctctagtctgcagctcccagcaagattgaggcagaagataggtgacttctgcatttccaactgagtcttagcaacaggcagaccaggagataccctcccgtgcctcgatcggcaggtgccacacccacggagacttgctcactgctagtgcagcagtctgagatccacctgatatgctgcagcttgatagaggaggggtatcagccattgctgaggcttgagtagcttactgtgtaaacaaagaggcctggaagcacgaagtgggtggagcccaccgcagctcagcaaggcctactgcctctgtagattccacttctgggggcagggcagagtagaacaaaacacaggagacagacagcctctgcagacttaaacgtccctgtctgacagctctgaagagagcagtggttctctcagcacggtattcgagctctgagaacggatagactgcctcctcaaatgtgttcctgacccccctgtagcctgactgggaaccactttccagtagaggccgacagacacttcaaacatgcgggtgcccctctgggatgaagcttccagaggaaggatgaggcagaaatatttgctgttctgcagcctctgcaggtaatacccaggcaaacagggtctgaagaggacctccagcaaactccaaaagacctgcagctgaggagtctgactgttagaagaaaaactaacagacagaaatagcatcaacatcaacaaaaaggacatccacaccaaaaccccatttgtaggtcaccaacatcagagaccaaagatagataaaaccataaagatgggaagaaaccagagcaaaacagctgaaaattccaaaaaacagagcatctcttctcctccgaaagatcacagctcctcaccagcaagggaacaaaactggacagagaatgagtttgatgagttgacagaagtagtcttcagaaggtcggtattagcaaacttatccgagctaaaggagcatgttctaacccatcacaagatagctaacaaccttggaaaaaggttacatgaatggctaactaaaataaacagtgtcaagaagaccttaaatgacctgacagctcaaaaccatggtacaagaacttcgtgatgcatgcacaagcttcaatagccgattcgatcaactgtaagaaaggatatcagtgatcaaagatcaaactaatgaaataaagcaagaagacaagattagagaaaaaaaagtgaaaagaaatgaacaaagcctccaagaaatatgggactatgtgaaaagaccaaatctacatttgacaggtgtatcagaaagggacagggagaatggaaccaagtcagaaaacactcttcaggatattatccaagagaacttccccaaactagcaaagcaggccaacattcaaattcaggaaatacagagaacaccacaaagatactcctcaaaaagagcaaccccaagacacataattatcagattcaccaaggttgaaatgaaggaaaaaatgttaagggcagccagagagaaaggtcggcttccccacaaagggaagtccaccagactaacagcagatctctcagcagaaaccctacaaaacagaagagattgggggtcaatattcaacatacttagggaaaagaattttcaacccaaaatttcttatccagccaaactaagcttcataagtgaaggagaaataaaatactttacagacaagcaaatgctgagagattttgtcaccaccaggcctgccttacaagagctcctgaaggaagcactaaacatggaaagaaagaactgctaccagacactgcaaaaacatgccaaatggtaaagaccatcgatgctatgaagaaactgcatcaattaatgggcaaaataaccagctaacatcataattgcaggatcaaattcacacatatcaatattaaccttaaatgtaaatgggctaaatgccccaattaaaagacacagactgatgaactggataaagagtgaagacccattggtgtgctgtgttcaggagacccacctcacatgcaaagacacacataggctcaaaataagaggatggaggaagatctactaagcaaacagaaagcaaaaaaaagcaggggttgcaatcctattctctgataaaatagactttaaaccaacaaagatcaaaaaagacaaagaaggccactacataatgataaagggatcaattcaacaagaagagctaactatcctaaatatatatgcacccaatacaggagcacccagattcataaagcagtccttagagacctataaagagacttagactccacacaataataatgagaggctttaacaccccattgtcaatattagacagatcaatgagacagaaggtttattttattttattattatttaagttttagggtacatgtgcacaatgtgcaggtttgttacatatgtatacatgtgccatgttggtgtgccacacccattaactcgtcatttagcattaggtatatctcctaatgctatccctaccccctccccctaccccacaacagtccccggagtgtgatgttccccttcctgtgtccatgtgttctcattgttcaattccaacctttgagtgagtacatgcggtgtttggttttttgtccttgcgatagtttgctgagaatgatggtttccaccttcatccatgtccctacaaaggacatgaactcttcattttttatggctgcatagtattccatggtgtatatgtgccacattttcttaatccagtctatcgttgttggacatttgggttggttccaagtctttgctattgtgaatagtgccacaataaacataagtgtgcatgtgtctttatagcagcatgatttataatcctttgggtatatacccagtaatgtgatggctgggtcaaatggtattcctagttctagatccctgaggaatcgccacactgacttccacaatggttgaactagtttacagtcacaccaacagtgtaaaagtgttcctatttctccacatcctctccagcacctgttgttttctgactttttaatgatcaccattctaactggtgtgagatggtatctcattgtggttttgatttgcatttctctgatggccagtgatgatgagcattttttcatgtgtctgttgggtgcataaatgtcttcttttgagaagtgtctgttcatatccttcacccacttgttgatggggttgtttttttcttgtaaatttgtttgagatcattgtagattctggatattagccctttgtcagatgagtaggttgcaaaaattttctcccattctgtaggttgcctgttcactctgatggtagtttcttttgctgtgcagaagctctttagtttcattagatcccatttgtcaattttggcttttgttgccattgcttttggtgttttagacatgaagtccttgcccatgcctctgtactgaatggtattgcctaggttttcttctaaggtttttatggttttaggtctaacatgtaagtctttaatccatcttgaattaatttttgtataagttgtaaggaagggatccagtttcagctttctacatatggctagccagttttcccagcaccatttattaaatagggaatcctttccccattgcttttgtcaggtttgtcaaagatcagatggttgtagatatgtggcattctttctcagggctctgttctgctccattggccaatatctctgttttggtaccagtaccatgctgttttggttactgtagccttgtagtatagtttgaagtcaggtagcgtgatgcctgcggctttgttcttttggcttaggattgacttggcaatgcgggctcttttctggttccatatgaactttaaagtagttttttccaattctgtgaagaaagtcattggtagctttatggggatggcattgaatctataaattaccttgggcagtatggccattttcacaatattgattcttcctacccatgagcacggaatgatcttccatttgtttgtatcctcttttatttcattgagcagtggtttgtaattctccttgaagaggtccttcacatcccttgtaaggtggattcctaggtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacgatgggtcctggacttttttggttggtaagctattgattattgccacaatttcagagcctgttattggtctattcagagattcaacttcttcctggtttagtcttgggagggtgtatgtgtcgaggaatttatccatttcttctagattttctagtttatttgcatataggtgtttgtagtattctctgatggtagtttgtatttctgtgggatgggtggtgatatcccctttgtcattttttattgcatctatttgattcttctctcttttcttctttattagtcttgctagcgttctatcaattttgttgatcttttcaaaaaaccagctcctggattcattaattttttgaagggtttttgtgtctctatttccttcagttctgctctgattttagttatttcttgccttctgctagcttctgaatgtgtttgctcttgcttttctagttcttttaattgtgatgttagagtgtcaattttggatctttcctgctttctcttgtgggcatttagtgctataaatttccctctacatactgctttgaatgtgtcccagagattctggtatgttgtgtctttgttcttgttggtttcaaagaacatctttatttctgccttcattttgttatgtagccagtggtcattccagagcaggttgttcagtttccatgtagttgagcagttttgagtgagcttcttaatcctgagttctagtttgattgcactgtggtctgagagacagtttgttataatttctgttcttttacatttgctgaggagtgctttacttccaactatgtggtcaattttggaataggtgtggtgctgaaaaaaatgtatattctgttgatttggggtggagagttctgtagatggctattaggtctgcttggtgcagagctgagttcaattcctgggtatccttgttaacttttggtctcgttgatctgtctaatgttgacaatggggtgttaaagtctcccattattattgtgtgggagtcaaagtctctttgtaggtcactaaggacttgctttatgaatctgggtgctcctgtattgggtgcatacatatttaggatagttagctcttcttgttgaattgatccctttacctttatgtaatggccttctttgtctcttttgatctttgttggtttaaagtctgttttatcagagactaggattccaacccctgcctttttttgttgtccatttgcttggtagatcttcctccatccctttattttgagcctatgtgtggctctgcatgtgagatgggtttcctgaatacagcacactgatgggtcttgactttttatctaatttgcccatctgtgtcttttaattggagcatttagcccatttacatttaaggttaatattgttatgtgtgaatttgatcctgtcattatgatgttagctggttattttgctcgttagttgatgcatttttttcctagccttgatggtctttaccttttggcatgtttttgcagtggctggtaccagttgttcctttccatgtttagtgcttccttcaggagctcttttagggcaggcctggtggtgacaaaatctctcagcatttgcttgtctgtaaaggattttatttctccttcacttatgaagcttagtttgtctggatatgagattctgggttgaaaattctttcccttaagaatgttgaatattggtccccactctcttctgccttgtagagtttctgccaagagatcagctgttagtctgatgggcttccctttgtgggtaacccgacctttctctctggctgcccttaacattttttccttcatttcaactttggtgaatctgacaattatgagtcctggagttgctcttctcgaggagtatctttttgacattctctgtatttcctgaatctgaatgttggcctgccttgctagattggggaagttctcctggataatatcctgcagagtgttttccaacttgcttccattctccccatcgctttcaggtccaccagtgagacgtagatttggtcttttcacatagtcccatatttcttggaggctttgttcatttctttttattctttttctctaaacttcccttctcgctttatttcattcatttgatcttccatcactgataccctttcttccagttgatcgcatcagctcctgaggcttctgcattcttcatgtagttctcaatccttggccttcagctccatcagctcctttaaggacttctctgtattggttattctagttatccattcatctaattttatttcaactttttaacttctttgccattggtttgaagttcctcctgtagcttggagtagtttgatcgtctgaagccttcttctctcaacttgccaaagtcattctccatccagctttgttccattgctggtgaggagctgcattcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctgacaggaccctcagctgcaggtctgttggagtttgctagaggtccactccagaccctgtttgcctgggtatcagcagtggtgcctgcagaacagcagtggctgtagaacagcagatattggtgacctgcaaatgctgctgcctgatcgttcctctggaaggtttgtctcagaggagtacctggccgtgtgaggtgtcagtctgcccctactggggggggggtgcctcccagttaggctgctcaggggacagggacccacttgaggaggcagcctgcccgttctcagatctccagctgcgtgctgggagaatgactactctcttcaaagctgtcagacagggacatttaagtctgcagaggttactgctgtctttttgttcatctgtgccctgcccccagaggtggagcctaaagaggcaggcaggcctccttgagccgtggtgggctccacccagtttgagcttcccagctgctttgtttaccttatcaagtctgggcaatggcaggcacccctcccccagcctcactgccgccttgcagtttgatctcagactgctgtgctagcaattagtgagactccatgggcataggaccctccgagccatgtgcaggatataatctcctggtgtgccgttttttaagcccgttggaaaagcacagtattagggtgggagtgacctgattttccaggtgctgtctgtcacccctttctttgactaggaaagggaactccttgaccccttgcgcttctcaagtgaggcaatgcctcgccctgcttcggcttgtgcacagcacgctgcacccactgtcctgcacccactgtctggcactccctagtgagatgaacccggtacctcagatgaaaatgcagaaatcacccgtcttctgtgtcactcacactgggagctgtagaccggagctgttcctattcggccatcttggctccaccccccgagttttggcttttaattgaaagtgtattgatgtgggaaggagataatgccatgcatttatgagcacatattagagggtctgagacaatgcatgtgataaaaggtcacctaaggaagaaaaaaagaacaagggaagacactggaaagaacgtgatgctgggagtccctgggccaccaaagtctggagaaaagtggtaaccacaaggctcccagcctagtttcactgaagacctcgacactaggtgacttatgggatccttggtaggacaagccttgaaaagttttacaatagcaaatgtggacgttgtcagaaccaaatgatgtcacgtgtgtatttgtgtgtgtgtgtcagtgtgtgtgtttaaaaatcatgacaaataaagcaggctgtgaagaggggattcccatgctcgtgtgcctgataacacaactatcacaaacgctttgcgaaaccacaagtttgcacaaaggcaatcccaaccttacacaaaaatatttctgcaagggcacctgcccagcgactgcctgtccaaccttggtgtggtgtcacccttgttattgatcttttagcaaaggagaattatttcaaaactgatatgaaatcctcctcatattttccttggaacatctttgtcttgctttacctccctgaatttccacatagtttgtaatggtcacaaactatgtgcatagtcagcaatacattttttgtttactttgatgctacagtttctaattttgctttatttaatgcttctcaatatgcttgtttaactgttgcagatcccgctgaaattacgcttaggaggacttcttcaaccagaaaaacccattgttctaaaggttgagtcaagggatgggaccgtaagtggaacctgaatttccctaaggacttctgctttgctcttcaaaaaagctgtgacctagaacaccagagacctcaaattactttgtgaatagtaccctgaaatgaagatgggcttcatccactgtactgcataaataaccagggattctgtacatgcactgagctctctccctgtctgtgtagagtgttatacttgggaatataaaggaagtgaccaaatcagtgcttgggaagtagatttggcttctttgtttctcacaggacaatctcagccacccctagttagcaccattaactcctcctgagctctgataaaagaatcaaaatttctcaataatttcatccaaaattattaatgaaaataagaattattttgatggctctaacagtgacatttatatcatctgttttatctggagcattctataataagtttatattaagcaaatcaataaaaacctcttacaaaagtatcatcggatactttcctgaacattaaggagaaatctatagaactgaatgaatgagaaccaacaagtaaatatatgtgatcattgtaaccattgttggtgtggggcatttgtcagaactccaatgtgattattaacataggtgagaattaatccactgtgactttgcccattgcttagaaagaacattcatagtttaattatgccttttttgaccaagcacagtggctcatgcctgtaatcccagcactttgggaggccgaggtgggtggatcacctgaggtcaggagttcgagaccagcctgaccaacatggtgaaaccccatctctactaaaaatacaaaaattagctaggtgtggtggtatgcacctataatctcagctacccaggaggctgaggcaggagaatcacttgaacctggaggcagaggttgcagtgagccgagacgcaccattacactccagcctgggtgacagagtgagattccatctcaaaaaaaaaaaaaaaaaattatgcctttttgaagcacatacattttataacatacaactgaatcccttattatattattagttttgatttaatgttttcaaaccatctcccctgatatttctgggagatgggaaacatgttttcttacacctcttgcattccattctcaactcccaactgtcttactgcaatgaacacttaataagaaacagtcaattggtcaattgattgggcaacaggctaaacacactcattccttgtctgttcccacttctttctttactttcccttcctgagtaacttatcctaaagtcattaggtgggtggcagccagatggtggccacacattaaggtagaaaagagagtgtcatgatggttccaagtcagagacctagtagggtgaggatcaagtaggtgttcacgtggagaaacagcccggcctgtgtgtgggagtccaagcaagcagagaaaatgtcgacacagaggggtggcctgaaaaagcagccagagcctaaacagggcatggagaacatatttagggcatgaggtgaggagggcatccatgagtgggaagggatgggtgaggtttcactacataaaggggattgatgaaataagtaaataaagtatactggaagccaggtgtgtcacttttgcagaaaagagtcatggattcagaaagggagaaaactagcaggaatcctatgaaattagattaaaatggatgtatccatgtatattcatacccttctagatagataaatggttagataggtgataaaaagataacaagaggacaagataattagatagacataaatgtatgtatgtgtttgtgtgtgtgtacaaaaaaacatatactccctacttctctccactgatagggctaggtaacaatggcatttcaatagcaatgagcacacttagtggccagatcttggcttattaataccattttccactgaaaggaaccagagctttttagagaaatggctgattccagggccaggattaagaatgttcaagataagcctaggatacattttgtgccaggaagcaagaagatgttcaaatgatttccaagtaatgtttggaaatgatatttgaaaatgatttccaaatgatatttccaaatgatttccaaatgatatatggaaacacttaaagactccactaaagaactattagatctgataaacaaattcagtaatgttgctggatacaaaatcaacatacaaaaaccagtagcatttctgcatgccaacagtgaacaatctggcaaaaataaaaaatgtaatcccatttacaataaccccaaataaaactaaatacctgggaattaacttaagagaaagatgtctacaattaatattgtaaaacactgatgaaggaaattgaagaagacacaaaaaagaaggatattccatgtttatatattgtaagcattaatattgttaaaaatgtccatactacccaaagcaatgcacagattcaatgcagtctctcaaaataccaatggcattcttcaaagaaatagaaaaaaaaaaaccctaaaatttgtatggaaccacaaaagacccagaatagcgaaagctaccttcagcaaaaagaacaaaactggaggaatcatattacctgacttcaaattatactacagaggtataataaccaaaacagtatggtacttgtataaaaacagacacagaccaatgaaatagaatagagaacccagaaacaattccacacacctacggtgaactcattttcaacaatgttgtcaagaacatacactgggggaaaagacagtctcttctggtgctgggaaagctggattttaacatgcagaataatgaaactagaaccctgtatctcaccagacacaaaaatcaaatcaaggtggacgaaagactgaaacctggctgagtgccgtggctcatgcctgtaatcccagcattttgagaggccgaggcgggtgtatcacttgaggtcaggagttcaagaccagcctggccaacatggtgaaaccacatgtctaccaaaaaatacaagagttagctggacatgctggtgcgtgcctgtagtcccagctacacagaaggctgaggtggcagaatcacttggacccaggaggcggaggtggcagtgagctgagatcatgacaatgcaccccagcctgggcaagagagtgagactctgtcagaaaaacaaaaaacaaaaaaacaaaaaacaaaactgaaatctgagacctcaaacgatgaaactgctacaagaaaacattgtggaaactcttcaggatattggtctgggcaaaactttctgaagaactaccccacaagcacaggcaaccaaagcaaaaatggacaaatggatcagatcaagttaaaaagcttctgtaccacaaagaaagcaatcaacaaagtgaagacacaaaccacagaatgggagaaaatattttcaaagtcacactctgacaacagattaatagccagaatacatgaagcgctcaaacaactctgtaaggaaaaatctaataatccaatcaaaaaatgggcaaaatttgaatagacatttttcaaaagaagacatacaaatgccacataggcatatgataaggtgctcaacatcactggtcattagagaaatgcaaatcaaaaccacaatgagatatcatcttaccccagctaaaatggtttttatccaaaagacaggcaacaacaaatgccagcgagaatgtggagaaaagggaacccttgtacactgttggtgtaaattagtgcaaccactatagagaacaatttggaggttcctcaaaacattaaaattaacattaaatagagctaccacaatatccagaaatccccatgctgggtatatacctggaagaaaggaaatcatatattgaagagataacatcactccaatattcacaatagccactattcacaaatgccaagatttggaagcaacctaagtgtccatcaacagatgaatggataaagaaagtactccaattatacacaatggagcacaattcagccatgaaaaaagcatgagatcctgttatctgtaataatatggatggaactggaggtcatcatgttaagtgaaataagccaggcacagaaacacagatattgcaagttctcacatacttgtgggatctacaaatcaaaacaactgagctaatgtctgggccttagtcagtgttgtacccaagtactgggagcacagcttttaaaatacatcatgaatgctttaatacaggaatgaatagatgagaggcacaaactggttgggtgttcttctgatacacagtatcttccttgacagattcagtacaactctcaacaggtaagtctcttcatgttatgttaccttatgaggaattaagtggcagaacatgatttctattattttcctttgcagaacaagaccaactttattagttgggacacagtgtggctgcatttgagtcccaagcaaccattagtctattgctatcaccacagagtcagaggggatgagacgcccagcaatctcacccaagacaactccaccaacattcctggttacccaccatgtgtacagtaccctgctaggaaccagggtcatgaaagtaaataataccagactgtgcccttgaggagctcacctctgctaagggaaacaggcatagaaacttacaatggtggtagagagaaaagaggacaataggactgtgtgagggggataggaggcacccagaggaggaaatggttacatttgtgtgaggaggttggtaaggaaaaattttagcagaaggggtctgtctggctgggcttggaaggatacgtaggagtcatctagagggcacaggtacactccaggcagagggaatttcgtgggtaaagatgtgtaggtgtggcttgtgaggatggatttcaattattctagaatgaaggcagccatggaggggcaggtgagaggagggttaatagatttcatgccaatggctccacttgagtttctgataagaacccagaacccttggactccccgataacactgattaagcttttcatgattcctcatagaacatgaactcaaaagaggtcagcaaaggggtgtgtgcgattctttgctattggctgcagctatagccctgcctccttctccagcacataaatctttcagcagcttggctgaagactgctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgtgagtaactgtccaaactcctctctttgtttccttggacttggggtgctaatcgggccccttttcccttatctgttttgaagatcaaaagagatgttcaaggagaagtagctgaagtgttggacgctacaaacgcatagaagttattattatcttatgcagatctatgaatgaataaataagcatttctcccatccaccttctaattttggtgactaggagggtttagggacagcatttggtagtgggaatgatttgattagcttagatctgacgaagactaatcaatgaaaacatggcagcggcagattacaaactgctgatcatgatggacagtgtgatcctcatccccttcccaggctctggggattctgggtacaggaaggagtggcttgcatttttgtctcattaattcgctttctgggttctgtgtctgctggaagggatgtgtagctgtattgcccctgtagacctggttcctgctcccccgccttccaacccaggatatcatttacataacgcaccaggggacaccaagacttcatgggaagctgtcccctggctcttccctctttcctgtgccatgcccctgaaaatcccctccctcctatgagtcactcctccaccctgtcatacacaggatggtttatcttgcaatgattaacctctagagcaaaggagacctggaggaagtttcgaggatttattctttgctttaatctttttcctcccgtctctgggaggctaggattaatatagagctttgtttctcacctaatgggaatctactagcagcctgaaaaggcaggagccatgaaagccaatttggattttacatatttttcccctttatgttacagtacaggagggcaaaccctctcactggtgggattcctggcatcctagagcaggtggagagaagagttactttccactgtgggtagtggaggctccacctgtcccattaacttctacctcaatttgacttttattaagagcagggaaccacaatgacatgaaaatagacactataaacctcattttaattctttcacagaaagcttaggaattcagtgagttgtggcaacatggtttccattgtctaacatttttaaatgaattgatatggtttaaattcattcatttttaaaccagaattttttggagatagactatttccagcatgttccttctggatggtaaaacagggctgttagttcagtatttgtgacaataagtgtgtgtaaaataatgtcacctttcctgaatgtcaggaatatgagtctaatgcacaaatgtatacctctaagacaagactgcacgtcttttcaaatatacctgtccggccatttattttaataactccttttcgaatatacctgcttagcagattgtcttaaactctcaggacaggggagtaagcaagactgtgagccagtgacgatagcaaaggcttccaggtaggatccatatgaagtgagaaaatattcctcagctctcagggtagaactccaaagagatattcatgggtcctggccccaccgtggaggtcactcaaagggcaaacaggttggcatctcatctgcttcaagcctggacacaggggcaccatctgtgtcactctgtgtgtggtctgccatgttgtgggccggtcactacagactcgggcagccaggcagacaatgccttagccttagacaatgctggtgcagcccaggagtcagaaaatgcagtgtagaccaggccctccttaggccaacacaattacatgcaatagatgactggcttttctgttagtctcttcactggacccaaaggctgcattactctaccagaggggagctggaaagaaactaaagagttcgcccagcacagcatctgccttgacatggtaccatgtgaatctagacactcaccaagatctttccttgggggccaatgctgctgacacattaactcaatagcttgtcctcacctgagaggtcaggtaatgtgtttaaagttcaggagcagagattagtgtcattgatttgacatggctgtgacaacaaaggagggaactgaagtgggaatacccaaggccaccctggctttggcaggtggtgcacgcacttccactaactgttctggggcagggaaccaaatgtatgactgggcctgctcatgctgcccctgctgagtcctccaaaccctgcccttcatgtaatttctcagttttattttatcacattttataagtcactggatgtttacaaaatgtttggaacctatactgccttgaaggctaacctctaaagaggagtaaacaaggtcttaatacaactctccgggacgttttatcattacttatcttatatgccatactgcaccatttgctatcaacaggaaagtacctggactttggaaggtccctctgtgtcttttagctgaaagtacatatgaggcatgtggattcttttatgcacatcatctttttcagccacatttttgtagtttgcctctctggagccaactgtgtggggctagcagcttcacagctgaatcagtgtctggcaacctcttccttcagcctctcttcttcctccagttttccatccctcagtcacaccggagggggaaggtctgcaaggatccagaaccatcagttggaggagtttgcacatgactcatgaaagatgagttccaggcaggcctgccatagtgaacaccaggcttaatgggtttttcctcagagatacttcacgtacagaggcagtgaactgactgctttctggttgaccaccttgaaaaagatgagtgtgcctggcactgtgcttctcaggtgagtatgacctgagaagtattagttgctggttcttctgcacacaatcattcaaggacatatggatcaaccatcctcctcaacagctcaaatcaaccagatcatctgaccacagagactgaggtgtacctgaaagctgcccacatttctataaggccaatagaagccatgaacacagttgtcaatctgtagaaataaggactccatgactcctccaaggcctctctgtgaatgaacgtttaagaagggctagatcctaaaacagggtcagagcttagagggaagaaaaagcataaacatttctgagcaaattgtaagggcagtgtcaccataggctcccagtgaccctctgtgattgagtgcatacagtgatgcaaaatctcatcatcagtgcaaaagacaaaaaaaatcttactctttctacctaggatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtgtacatattacctccctctcttgaccattccagttcctgagtaactcaccagccctctgatctataaagtcacaatccctgtgacctgatttctgtttcactttgtagatatgggacccgtacacatggactttttaagagactgggaattccagggcccacacctctgcctttgttgggaaatgttttgtcctatcgtcaggtgagttgcttgagcttcctcttttgcttcttatggttgcaaacatcagcttagttccatcagtaaaaatgcccctccttgggagggagttctgaggtttcacattttcagaaatggtgggactgggtgcagtggatcatgcctgtaatctcagcctctgtgaggccaagactggcaaattgcttgagcccaggagtttgagaacagcctgggcaacacagtgagacacctgtctctagaaagaaaaaattacctgtgcatgatatggtagcccatgcctgtagtcccagctactctgaatgttaaggtgggaggattgtatgaacccaggaagtcaaggctgtattgagctgtgatcgcaccactgcactccagcttggtcaacagaacaagacagaaaggaagaaagaaagagagagagagaaagaaagagagaggaaggagaggggaggggaggggaggggaggggggaggagaggagaggagagaaaaggagaggagagaggagaggagaggaaaaggtgtgtaggctccacccaaagcatggccaggtttacccctggagggaaagtcacaagctcatgtccagaaggccagtagcagcaagctgctctccagcccagatttcctatcctgtgtacctggagcttgtttctcagattctaactctcacaactgaagcctctgttgtctgattactatctgagaattctacacaattttaccctcgataaaagcagtaatttcttcttcatctttcccagatcaactcttgtagtagatcaacatttctgggaccttcttttgcatggttaaaacatcacagctgaatcttagcaacaggaaggtttgtttttatgtttcagaagtgaaagctcagagcacgcattgtaatttgctgggtgtgatgtgtagaggtggcatttctccatcttttctgtgttaagctagaaaactggaaaggaagtctactttctcattcactcactcactttctcactcaacaacatgccttagacttatctaaatctgcaagactaaaagaggttcctggtttctttaactttctaattctgctagagttctagagagagcacatgagataaatgaaaaggatactgatggaggagattaaaaaattgtgcattccctgcagacactcacttttcctcacctcagtttcacccctgcccttgcaggtgatcattcacggggttaggagactttagagagaataaaagaaaaagcaaaaatacatcagaaagacaaggaattacttactggtcatagacaagggtgagtccttcagtacttagagaaaattcaagagtgactttaaattccccacttcaaatatattctctgttttcttgtctttcccttaagacatctctgaatagcttccttcaactgccagtgaaagatagcaggcctgatttcattggacgcaactgttttcagccccaattagaggtagggtttattctatttaaaataataatcaacttgtattttgtttcctctcccagggtctctggaaatttgacacagagtgctataaaaagtatggaaaaatgtgggggtgagtattctgaaaacctccattggatagacctgctactgtgaggaggttaccccactgcaggatagtctctgcccaggtcttcatgggatgaagctcttgtcaacctaaatacaaacagagagaggttctctgaaagaagaggataattacttgggagtagaatattgcaatgggaatctgcttgccgttataaactatgtgcaaattcagggaggtaaacaagacaaagatgctccatagaaaatatgagaagaatctcataactgttttgagataattattgttagctacaaagatcaataacaagggtgatgccacaccaaggttggacaggcagttgctggacaggtgtccttgcagaaatatttttgtgtaaagttgaaatagcctttgtgcaaagttgtggtttttgtagacacttttgtaatagttttgtttccaggaacacaagcataagaatcctctcttcatagccttcttgggatttatttgtcagggttaaaaaacaattagtgacatcactttggttctgataaagttcacactcgctattgtaaaacttttcgaggcttgtcctaccaaggatcccatgtgtcaccaggtatcgaggtcttcagtctgaactaggctaggagcattgtggttaccacttttctgcaggttttggtggcccagggactcccagcatcgccttctgtccagtgtctgcctattcccctcttctttttttcttccttaggtgcccttttatcacatgcattgtctcagacccttctaatatgtgctcataaatgcatggcatcatctccttcccacattgattcactttcaattaaaagccaaaactccttcatttagactgaatttaacatgtgcttttgaaagaagggttgagagataatagagaaacagattgggaaaccacttatgctccacttttttaaactttctctgcaagtatggaattttttgttctgctttgttgtttaaatttaagccaaaacttcttaatagaaggatatacaaatatttattggtttataccattgcacttactttgaagaagagatgctgaatattattaaaccattgtgttccctggtgggctgatggactgtgattttataaggtggtctcagccaattgcagcagctgttccctgtcagaggggctagaggtttggtgagagcagtggatgaggtgcagtggtgtgtttgttcactagaagcaagtgggagaaagctttgcctctttgtacttcttcatcttctcccctcaagtcctcagaatccacagcgctgactgtggagtgctgtggagctggcatggcccatacaggcaacatgacttagtagacagatgacacagctctagatgtccatgggccccacaccaactgcccttgcagcatttagtccttgtgagcacttgatgatttacctgccttcaatttttcactgacctaatattctttttgataatgaagtattttaaacatataaaacattatggagagtggcataggagatacccacgtatgtaccacccagcttaacgaatgctctactgtcatttctaaccataatctctttaaagagctcttttgtctttcagtatctcttccctgtttggaccacattacccttcatcatatgaagccttgggtggctcctgtgtgagactcttgctgtgtgtcacaccctaatgaactagaacctaaggttgctgtgtgtcgtacaactaggggtatggattacataacataatgatcaaagtctggcttcctgggtgtggctccagctgcagaatcgggctagtgaagtttaatcagctccgttgtccccacacagaacgtatgaaggtcaactccctgtgctggccatcacagatcccgacgtgatcagaacagtgctagtgaaagaatgttattctgtcttcacaaatcgaagggtaagcatccattttttgaaatttaaataatgattgatccactgattaaatttttattttgaaaaaaacatatattcacagaaggttacctaaaaaatgtacaggaaggttccatgtactcttcatcctgtcccgcccagtggtaacatcttgcaatcttgtatattgcaatatatatctagtatattcatattatcaggttggcacaaaagttaaaatggcaaactacaggctgggcataatggctcatgcctgtaatcccagcactttgggaggccgaggcaggtggatcacgaggtcaggagttcgagatcagcctgaccaacatggtgaaaccccatctctactaaaaatacaaaaattagctgcgtgtggtggcatgcgcctgtagtcccagctactcagtagtctgagacaggagaatcgcttgaacctgggaggcggaggttgcagtgagccgagatcacgccattatactccagtctgggcaacccaatgagactccatctcaaacaacaacaacaacaacaacaacaaaaaccggcaaactgcaataacttttgcaccaacctaatactatagtacaggaaattgactttgatatagtttacagagcttttcagatttcaccagttttacatgcccttgtttgtgtgtgtttatgtgtgtgggtagttctaagcaatttttcacattcgtagatttgtgcaacgaccagcaccatcaagatgcagacccattccgtcaccatgtggctccctcctgctgtcctacagtcacaacatggagtttgtctttttctctgacaggttctatatcagagcaaacttttatttatttgaggaggccaatgtattaatatttccttttatggattgttcttttggtgttaagtctgaaaatcctttgcttagccctccttcctacattgctttttctaagagttatatagtttaacactttacaaaatgtaactctattacccattttgtgttaatatttgcataagttatgagatttagatcaaggttcattttctgtggactatggctgtccaaatgttccaacaccattttggaaaggtaggcatattgtcaaaactcagctgagtatattttgtgaatctatttcttattgtttactcctccactaataccacactgtggtgactctagtagctgtacagtaactcttaacatcatatagggcaattctttccactttattgatttatattttcagaatggctttagcttttcttgtcccttgcctttccataaaaattcagaataagcttgtaagtgtctacaaacaaacctgccataattttgataagaattaaagcagaggtgtccaatcttttggcttccctgggccacagtggaagaagaagtgtcgtgggccacacataaaatacacacacacacacacacacacacacacacacacacacacacacacaaatggtctgtgtatagttttcattatatatctaccaccacagataagcaaaaatgtccttgcataataatcctaattatgcactgccccattcagagggtctttcaaaatcattgaacaggttccaagtttgcaatcactgatacagaaaatgtacatatctagctaaacttcactacttttttgatattttttattataaaagaaaagagaacaacataaaactagtggggtacttgacattgtttttgagaaactaatccatcagtatctggcttgatggaagtagttgcaattctcagtgagttctcaaggtgctcatcagatattttggttctaattttactcttcgtgttcttcatccttgaaaatagtagctcacaaatgtaagtgctgccaaaaagcaatgacatgaacaaggtgtgattgtgaagcaagggatatttgtcattgggaagacaggtcttacaaaagtccagtaaagaggcaaaatcaaatttttctataagttgaacatcagattgcagctctaggcattccatttcaaaattgccaggtaacatatatatgtcgactgaaaatggagttgcaaatataccaaaatattgatgattttttcagaaatcttgaaatacctgttttcaaattcctgtatcaaattgaaaagcaaggctgcgtatttttggctgttcacaggaccatgtttagccaacatgtcgaaatgcataaaattgtttgccttaatttgagcttgccataatttcagtttcatatggaatgctgttatggtttgaaacattgtattgttaagttggttttcaacttgaagacacaggtttaactcacttaaatgggccgtcaaacccactaaaaatgctaaatctgtaagccagttttcattgtcaagttctggcaccaattttgtttgataccataaacagcttgatttcacatcacaaagcataaaatctttacattttgccttgacttaaccatcttacttctaaaaagtgaatgacttgctagagtcagcatccatacttttaaggaattcctgaaactagcgatgattcaattcctgggcccttgtgaaatttacagccttgatgacaatttgcatgacgttatctacttttaaagcttgtgcacatggattttcttgatgtattatgcaataatacttcatcaaatgtgagttttgtgtggcaactgcatcatctattaattgtacaagtccctctcttttacctaccatcgccagggcagcatctgtagctatatcacatatgtttacaaaggacaaagaaaattgctttaacatatttttcactgcttcatataaatctcttgatttagttgtgtcttttaatagcatggtgacatttcgatttcttcagtgacattatattcatcatcaatacctctaataaaaatagcaagttgtgccgtatctgtagtgtcagtgccttcatccatcaccaaagcataaaattttaaattagcagttttactctccaaacgtctttcaatagatttcccaatttctccaattctcctggctatagtctggtgagacaaactgattttagaaatatcagtttctcaaggcaaataatatctaccacatcttccagacattgcttaataaactcaccatcagtaaatggttttgatttttttgctattaaatttgctaccacataactaggttttaccttacgattgagtccgagttgtaactttttaaaaaatcttttttgttgaaaagacagactttttttcagttctgctattttgtccttacaacacatacacaccaaatttgtcagcacgtttttgcatataatgcctcttcaaattgtagtctttgaaaactggcacaaattccgtggaaattaagcagagtgcttcgctatttgcctcaacaagaaaaagtcatttgtccacttttcattgaacaatcttccttcatccataatttttgttttttagggttttctttttaagacattgtggaagccattctggaattaaaagcattataatagataagcaactatatttacttttattatggaaattaacagataggaaaatagaacagaaagcaaggtttaataatcaaataagaatacttacatgtcttctaaataatattaaacacctatcatctacaaaggtaggttgaaatattattgataattgctgggttttacttgccaaattgccacaaacacacctaatacctgacagtgtcaattcaactgtccgtgattagaagataacacactggaagtcgcacaccaccataaaactgaagccacacatgcgtacaaatggcgacagtgtctggtgtacagcagcgctctgccttgtccagaatacacacttgaattctttgtcacaattcacttcacgtggcactgcaatagcgtcctctcgctctttgttagttaattttaatggcttttaatttcttcttgctgaactgtttgcaattataatgcaaattatggatactagtccattatttgtggatgtgacatactctgattacccctttccattccattgttgtctacgaagttcacacttgagaatcacatagtcaaattacaaaattacaaaaaaaattgcaaaaaaactcaaaatgttttaagaaagtttccacatttgtattgggatacattcaaagccatcctggactgcatgaggcctgcaggccacaagttggacaagcttgaattaaaccaatagaacaatttgggtataatctatatctttactatgttcagcctttcatcccgtgaatatagtatgcctctccatttctttagcttttattactttcctcaacattttatagttttcagcatagaggtcctgtacatcttttgttagatttacaccagaaatatttcatttttgttggagtaactgtaaatgatactgtttttcttgtattttcagatattgattattgttacatagaaatgtgaataattttgtttgttgatcttgtatcctatagccttgcagaacttacctattcgttctagaaatttttttgtatattccttgacattttatacattgacaattatgtcacctgaaaatagagacaattctattatttcctttccaatctgtatgccttttatttctttttcttgtctagtgtattaagacatcaggtatgctctttagtaagaatgttgagagtgggcattttttagttcttcttgatcttggaaaaaccattcagtccttcatcattaaatgtgatttaactgaatgatttttttacagattgtctttatcaaatgaaggaactgtctctctcttcctagtttattgagattttatcatgacagctggaagtacacattttaaaacaaaacatagttgtggaagataagagaaagttccaagcatgctggcttgatagtccagccccaagttgggaaaagtaattatccctttctttttccttctatttatggaataaaaaattaagagaaaagaattttcaaggaaattgcattattccttcaaaacaggtttctagtctttaagtattacctacttttcaaaaaaaaatcaccacatcatggcatccctttttcaagttgcccatgctgtaggtgtattaaagacagagctggtctgaggcaacatacagtctgcccatctgtcaccaatccttttctactctgcacactcctggggaagggctaggtcttgttcctgtctattccactggaagaacagttccctaccacgtggagcatttgcaattaaaaggagactgagatatagaggcaggagaccacaccagatggctgggtctccccactcccacccccgccccacatacactcagaagaggctaggcatctaggatctccattgagcatcttgaatatggcttgccataatatcatatacagtcaataaatatttgttaaataaggatgcctcttcaatatattttgtgcaaccatgaagatcaccacaactaatgtgagaaaaaatgtttctgttgaactctagtctttaggcccagtgggatttatgaaaagtgccatctctttagctgaggatgaagaatggaagagaatacggtcattgctgtctccaaccttcaccagcggaaaactcaaggaggtatgaaaataagatgagtcttaattagaaatgtaaagaatgaatctggggacaggtagaaagtaagatcacagtccgtttccaaggggtagtccactgagttcgagcttcctaaaaatggtcttttatctttatgtacagaaaagacatcacaaaattcattacaaaatgtcacttactgctccatgctggagaaagccatatccttctgggacttgagtctgcacatttaactacaggtactgatctgttttgtgcttagatgttccccatcattgcccagtatggagatgtattggtgagaaacttgaggcgggaagcagagaaaggcaagcctgtcaccttgaaagagtaagtaggagcacagccatggggttctgagctgtcatgagcccttccagctgcctgccatggagtcgacagtcgcactgttgggttactccagtgaccagacaaaagcagggcagcgctgcaactccaaagagccacctaagagggagtggctcccatgaggcggcaagtcagcaagggaaaagggccttctctcctgtgcacaggagccaggatttacttatctgttaacttgtcaccataaatattctgggagattaaatacatactttagaaattaaaaaaacatgattgtatcaaagttttgagtgtagtggatatggaactgtgggtaagcaagcatttggtacttgttgccttgcattgggtaagatgggaaagttacaatggggaacttggaacaatttcaatcccttcatggtttttctgagaatatcagcaaactatgaactattaaaccttcccactacttccttttcctccaatctcaaaaaagaaagggtgctagaaatgctatgtgtagagcaagcctattatttgctgtctacaatggtatgtgcttcaattatgcaggaacgacaggtgtaatctgagcctgtcctgttcagacttgggacatgtggtcactcagttttgggttctccaaatcaatgttggagagatctattttttttaaccagaacattcttgattgtcacatcttacaaaaatgactctgctctcagcgcaacttcaggtcagaggagctggggatagtggggttttccagagcattagcagggagtgtagagaataaaggatgatatttctaggaactcagaacagggtgttactgttttgtaaagtgttgaagaggaattggctctgggcatagagtctgtagtcagacaacgccacctttcttgaatccactaggaagagttaattattctactcttgttctgctgaagcacagagcttacatatcttatatcatccacactcaacacatgctactgtagttgtctgataatgggtctctgtcttcctatgactgggctccttgacctcagaggtgagtctaactcagcttggtgtctccatcacccccagcatagggccagctccatcactggcaccagataaccaccttctgagggagtagatggaagatgattcagcagatagttctgaaagtctgtggctctttatgtgtcttgactggatatgtgggtttcttgctgcatgtatagtggaaggacggtaagaggtgctgattttaattttccatatctttctccactcagcatctttggggcctacagcatggatgtgattactggcacatcatttggagtgaacatcgactctctcaacaatccacaagacccctttgtggagagcactaagaagttcctaaaatttggtttcttagatccattatttctctcaataagtatgtgggctattatttctttctctctttttaaaaataactgctttcttgacatataattcacatatcgtataattcatccacttaaaaggtacaattccattgtttttaagataatcaaaaatatgtatgaccattactattgtaaactaaaatgtttttgtcaatctagagccctcacacactttagctgtcaacaccccaccacaaaccccactgccctaagcatccaataatcaactttctgcctctatagatttgcctattctggacacttcatagaaataatatcattgatttttctctgttgttttttattctctatttcatgagtttattttagtctgttattttctttcttttgctggctttaggtttcatttgctcttcttcttttagtgttttgtggtgtaaataattataatcaatttgagatattttcttcttttaaatttagatattacagctataaatttccctctgagcactggtttggctacatcctgtgttttggtacatcatgccttctttttgttcatctcaaaacaatttcttgttgcccttttgatttctgctttgactcactggtcacttaaaactgtattgtttaacttccacaaatgtatgagtttcccaaatttctttcccttattgatttctagttttattccatggaagttgatgtacatatgctgtgttaattctatcttgactatcatttcctgaacagcatgattaagttaagcagcagattatggtctacattaatccaaaaactctagtccaatagataaaggctaagaggtcagggaatttaattctattactttggtcactccaaagactcagaaggtgccattgatctcactgctgtagtggtgtttcctatgtatagacctgcccttgctcagtcgccggcctgaaagaagggcaaacatgataaaaggaatgggttccagttgagaatcatgatgttcttattcttattactggtagagaaaattataattgctccaggtaaagtttgcattttcaatgatttccttttgtttgttttgtttttcccacagtactctttccattccttaccccagtttttgaagcattaaatgtctctctgtttccaaaagataccataaattttttaagtaaatctgtaaacagaatgaagaaaagtcgcctcaacgacaaacaaaaggtaaaatctgatggtggttaaatgacgatgtttaggttttgataaatttagattttatacacatgatagagcatgtatctgtatttttaaaaataaagacagagaacttatgtttagaacaagagaagccatttggtagaaataaagaaggagattggggaaggagatgagaatgagtcagagagatagcatttaaaacttgaaatcaggcacaacaattagtatgtcatgatataaacagtattgagataaaattttaccacttctcttccctttaataaattgtcaaaggataaagtttcctgtttgaaaatatattttactggtattgtgctttcctcatatcacagattggtaaagaatcattttaagtccaagactcttattttacatattctgcaattaaaggtcctatgaggctacctgccgactgctgacatgtagtgtgtggtaaatgtgagtgtttcacagcctggagtgaacaggggtcttctctgagaattgaggttgcaaggctggctaactcagctttgccttcacgagccctagaggccagccgaaggatgtctgcaggtcagggagacaggaccaggtaacccagctgtcactgaagattatatagagtttgagaatgttggaatatttgaaaatgctcccccaaaaaagctgctgatgagttctggaaatgtcaggagattaatctatacggacactgctgaagaaaaaggtagaagaataaaagatccagtacttcttcctgggtaagcagttatgaccagagatggaaccggcaactctttggccagaaagctgtatccaaaagacagagaagatgagaaacagggagggcaaaggcgaaaaagcaattggacatgatagctagatttgtttcaggaaaacatcctgctttccaaggatttagatgaatgtttttgttcactggtgactcaggtaacacgtcttcaagaagccatagggaggttgagggagggaagtcaagaagggaggttgaggactgcacttttgatttacttctgacttcacgagtcactttctgccaaagaaatctctccttttgcttctagcaccgactagatttccttcagctgatgattgactcccagaattcgaaagaaactgagtcccacaaaggtaaccaaggagtgcttctgagggctactggcggggacactaagagggagggccttgttctgaaaatgtgcaggaagtattccaggaagatgagaatttttgccacatagcagaacaacacacatttagatgttataaatggtagctggaggcactttccagaagcccacaggtatagccatgttccaggctgaaagggcaaccctaagcaaacctagaatgcttggaggacagtcagtggtttgtggatcacctacatgagatcaaatgccagttctcagcctcctccagatccaccaagtgagaacctctacttggaaatttatatcaaacataccgatcaggaagcacactatcccagtaagggtgattttaactggcagtacttgaaagtgtgttcgcaaggttaatctactgcaaagttttatttttccctttgaaatgcataagtaactaatgggggacacctctgataccatgtaaatctacttcaatcttcagtcttgtatctactagttttatgacccatggatggttttaaccaaaaccattattactaagacagtggcaaaatgataaccatggtcaatttcaagctaccaagatttggcaaccatctcacaaaatttttgaatatttaacaattggttctagagagcaggactcagcagactccagtataccactttaaacatgtccatgtctacatctacttctgtctgtctatctatctgtcaatcatctatctgcctataatttatcaattaatcatctatctatctcaacaaaacttgctgtgataaagaaaatagtctatcatttcactgtttcatatagaaatcactagacacatatggctattgagtactggacatgtggccaatgccactgaagaacaatttttaagagtatttatttttaattgaataaaatttgaatttaaatagccacatgtggatagtggctaccagattggacagcagagctcccaactttaaaattacagttcaatttcaactcagtataatggggttcaatgtaactgagtaaaataattggatggttgaatttacccacagcagcatacagaaatattcactgataaatcagaactctgtagacctttctcacactcattttatattgtgtttggttgtgagttacatgattgctgcaggcaccatatttatttctgtgctccaggtctctaaaggtcctaatccagtcctgaccaaacagactagtgatggaccatcgtgagcttctctcaggagaaatatcaagagggaggccaacctgtaatcataagaacttctgctattttaatgccattcatcagactacagtcaatcaccatgcttctggctttttgtctatctctgctgtcttgtacatcctgagatagtccattctgagaactgtaccctagatcttgtattgcctgatgcctgtcaaagatgtaatccatgctgcttaagtgaggttgtgcacacaaatcaccatatctcctgcaagtttggattttgattcagtagttcgatggtggggtttgagattctgcatttctaataagctcccagatgtggctggtgctgctggtccatgaaacacactttgagtagcaagaggtgatctgtagctcagtattggtcctttaagttccctcaaacatatatagagaaaaggtcctaaatattgcaaattctctcaaagtttgtcaagctatattggaattctctcaaagtctgtcaagctctattgtagaaaatcaaatttttattgggaaaaagcctaccccatatttacttacagataaagtacttttaggatcattcaaggcacacacccataacactgagtatgtaagacagaaatgctctctctggaaattacagcagtgctggtgctgggatgccatgatgaggagtgtgtggcccacaatcatgtagaccttgggaaaacctggattaaaatgattttgcgtcatcctggccctgtataagatacatatcagaatgaaaaccactcccagtgtgactttgaattgcttttccattttttcttcttgggattagagagcttcacttagatttcatctaagctgtgatgttgtacgttgacctgatttacctaaaatgtctttcctctcctttcagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggtgaggggatgacccctggagatgaagggaagaggtgaagccttagcaaaaatgcctcctcaccactccccaggagaatttttataaaaagcataatcactgattccttcactgacataatgtaggaagcctctgaggagaaaaacaaagggagaaacatagagaacggttgctactggcagaagcataagatctttgtacaatattgctggccctggttcacctgtttactgttatcacaataatgctaagtaaaaaaaaaaaaaaaaaaaaaaaaaaaaaaaggagtgtggcgagaagatggccaaacaggaacagctccagtctacagctcccagcgtgagcaacacagaagacgaatgatttctgcatttccaactgaggtaccgggtgcatctcaatggggattgttggagagtgggtgcaggacagtgggtgcagtgcacccagcctgagccaaagcagggcgaggcatcacctcacctgggaagtgcaaggggtcagggaattccctttcctaggggtgacggacagcacctggaaaatcaggtcactcccaccctaatactgcgcttttctgatggtcttagcaaacggcacaccaggagattatatcccgcgcatggctcggagggtcctacgcccatggagcctcgctcattgctagcacagcagtctgagatcgaactgcaaggcagcagcaaggctgggggaggggcgcccgccattgctaaggcttgagtaggtaaacaaagctgccaggaagctcaaactgggtgaagcccaccgcagctcaaggaggtctgcctgcctctgtagactccacctctaggggcagagcatagccaaccaaaaggcagcagaaacctctgcagacttaaatgtccctgtctgacagctttgaagagagtagtggttctcccagcacacagctggagatctgagaacagacagactgcctcctcaagtgggtccctgacccccgagcagcctaactgggaggcaccccccagtaggggcagactgacacctcacacggccgggtactcctctgagacaaaacttccagaggaatgatcaggcagcagcatttgcgggtcaccaataccgctgttctgcagcctccactcctgatacccaggcaaacagggtctggagtggacctccggcaaactccaacagacctgcagctgaggatcctgactgtcagaaggaaaactaacaaacagaaaggacatccacaccaaaacccatctgtacatcaccatcatcaaagatcaaaggtagataaaaacacaaagatgggggaaaaacagcagaaaaactgaaaaatctaaaaatcagagcacctctcctcctccaaaggaacgcagctccgcaccagcaacggaaagctggatggagaatgactttgacgagttgagagaagaaggcttcagacgatcaaactactccgagctaaaggaggaagttcgaacccatggcaaagaagttaaaaaccttgaaaaaagattagacaaatggctaactagaataatcaatgcagagaagtccttaaaggacctgatggagctgaagaccatggcacgagaactacgtgatgaatgcacaagcctcagtagccaattcaatcaactggaagaaagggtatcagtgatggaagatcaaatgaatgaaatgaagaaagaagagaagtttagaagaaaaagaataaaaagaaaggaacaaagcctccaagaaatatgggactatgtgaaaagaccaaatctacgtctgattggtgtacctgaaagtgacggggagaatagaacgaagttggaaaacactctgcaggatattatccaggagaacttccccaatctagcaaggcaggccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaacacaaacccatcagactaacagtggatctctcggcagaaactctacaagccagtagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcttgaaggaagcactaaacatggaaaggaacaactggtaccagccactgcaaaaacatgccaaattgtaaagaccatcgaggctaaggagaaactgcatcaactaacgagcaaaataatcagctaacatcataatgacaggatcaaattcacatataaaaatattaaccttaaatgtaaacgggctaaatgctccaattaaaagacacagactggcaaactggatagagtcaagacccatcggtgtgctgtattcaggaaacccatctcacgtgcaaagtaacacataggctcaaaataaagggatggaggaagatctaccaagcaaatggacaacaaaaaaaggcaggggttgcaatcctactctctgataaaacaggctttaaaccaacaaagatcaaaagagacaaagaaggccattacataatggtaaagggatcaattcaacaagaagagctaactatcctaaatatatatgcacccaatacaggagcacccagattcatgaagcaagtctttagagacttacaaagagagttagactcccacacaataataatggaagactttaacaccacactgtcaacactagacagatcaacaggacagaaagttaagaaggatatccaggaattgaactcagctctgcacaaagtggacataatagacatctacagaactctccaccccaaatcaacagaatatacattcttttcagcaccacaccacacctattccaaaattaaccacatagttggaagtaaagcactcctcagcaaatgtaaaagaacagacattataacaaactgtctctcagaccacagtgcaatcaaactagaactcaggattcagaaactcactcaaaaccgctcaactacatggaaactgaacaacctgctcctgaatgactactgggtacataacgaaatgaaggcagaaataaagatgttctttgaaaccaacaagaacaaagacacaacataccagaatctctgggccacattcaaagcaatgtgtagagggaaatttatagcactaaatgcctacaagagaaagcaggaaagatctaacattgacaccctaacatcacaatgaaaagaactagagaagcaggagcaaacacattcaaaagatagcagaaggcaagaaataactaagatcagagcagaactgaaggaaacagagacacaaaaaaacccttcaaaaaaatcaatgaatccaggagctggttttttgaaaagatcaacaaaattgatagaatgctagcaagactaataaagaagaaaagagagaagaatcaaatagatgcaataaaaatgataaaggggatatcaccacccatcccacagaaatacaaactaccatcagagaatactataaacacctctatgcaaataaactagaaaatctagaagaaatggataaattcctcgacacatacactctcccaagactaaaccaggaagaagttgaaactctgaatagaccaataacaggttctgaaattgaggcaataattaatagcttaccaaccaaaaaaagtccaggaccagatggattcaccgccgaattctaccagaggtacaaggaggacctggtaccattctttctgaaactattccaatcaatagaaaaagagggaatcctccctaactcattttatgaggccagcatcatcctgataccaaagcctggcagagacacaaccaaaaaagagaattttagaccaatatccctgatgaacagtgatacaaaaatcctcaataaaatactggcaaaccgaatccagcagcacatcaaaaagcttatccaccatgatcaagtgggcttcatccctgggatgcaaggctggttcaacatacgcaaatcaataaacataatccagcatataaacagaaccaacgacaaaacccacatgattatctcaatagatgcagaaaaggcctttaacaaaattcaacagcccttcatgctaaaaactctgaataaattaggtattgatggaacctatctcaaaataataagagcaaatttatgacaaacccacagccaatatcatactgaatggacaaaaactggaatcattccctttgaaaactggcacaagacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatctagaaaaccccatcgtctcagcccaaaatctccttaagctgataaacaacttcagcaaagtatcaggatacaaaatcaatgtgcaaaaatcacaaatattcttatacaccaataacagacaaacagagagccaaatcatgagtgaactcccattcacaattgcttcaaagacaataaaatacctaggaattcaacttacaagggatgtgaaggacctcttcaaggagaattacaaaccactgctcaatgaaataaaagaagatacaaacaaatggaacaacattccatgctcatgggtaggaagaatcaatatcatgaaaatggccatactgcccaaggtaatttatagattcagtgccatcgccatcaagctaccaatgactttcttcacagaactggaaaaaactactttaaagttcatatggaaccaaaaaagagcccgcattgccaagtcaatcctaagccaaaagaacaaagccggaggcatcatgctacctgacttcaaactatactacaaggctacagtaaccaaaacagcatggtactggtaccaaaacagagatattgatcaatggagcagaacagagccctgagaaagaatgccacatatctacaaccatctgatctttgacaaacctgacaaaaacaagcagtggggaaaggattccctatttaataaatggtgctgggaaaactggctagccatatatagaaagctgaaactggatcccttccttacaccttatacaaaaattaattcaagatggattaaagacttacatgttagacctaaaaccataaaaaccctagaagaaaacctaggcaatatcattcaatacagaggcatgggcaaggacttcatgtctaaaacaccaaaagcaatggcaacaaaagccaaaattgacaaatgggatctaatgaaactaaagagcttctgcacagcaaaagaaactaccatcagagtgaacaggcaaccgacagaatgggagaaaatttttgcaacctactcatctgacaaagggctaatatccagaatctacaatgatctcaaacaaatttacaagaaaaaaacacaaccccatcaacaagtgggggaaggatatgaacagacacttctcaaaagacatttatgcagccaatagacacatgaaaaaatgttcatcatcactggccatcaaagaaatgcaaatcaaaaccacaatgagataccatctcacgccagttagaatggcgatcattaaaaagtcaggaaacaacaggtgctggagaggatgtggagaaaacaggaacacttttacactgttggtgggactgtaaactagttcaaccattgtggaagtcagtgtggtgattcctcagggatctagaactagaaataccatttgacccagccatcccattactgggtatatacccaaaggattataaatcatcctgctataaacacacatgcacacttatgtttattgcagcactattcacaatagcaaagacttggaaccaacccaaatgtccaataatgatagactggattaagaaaatgtggcacatatacaccatggaatgctatgcagccataaaaaatgatgagttcatgtcctttgtagagacatggatgaagctggaaaccatcattctcagcaaactatggcaaggacaaaaaaccaaacactgtatgttctcactcgtaggtgggaattgaacaatgagaacacatggacacaggaaggggaatatcacacactggggcctgttttggggtgggaggagtggggagggatagcattaggagatataccgaatgttaaatgacgagttaatgggtgcagcacaccaacatggcataggtatacatatgtaacaaacctgcacgttgtgtacatgtaccctaaaacttaaagtataaaaaaaaaaattcaaaaacctcagtggcatctaatgagaagcatttattgctcacaagactggatagtgagttctgctgatactgactggactcactctggtctggctatggtctgaggtagcctggccctgggggcgcgatggaggctgactcagctctccccacacctgtctcatgttccagtcaggtagccactggccaagaagccaagctaggaaccagggtatctgactcctgagctaaactctaaccctctacaatactgcctcccaaatataacaccaagtgctaggtacatatcatccacagttttcagacttctgcccaaactgggattctttttagtgtgaagagacctggcctgtggggctgaccctggtgtggctgtgaggcagacacaaagggacatttacatccagtcctgaagattacagtccagccctgaagcaacaactaggaaactattccaaaaggaggggatggggctgagtgtggggttctattctcttcataactttaactagaactcaaattgtgtaccttggtagcatccaatcataaatttattttgtcgtatttgtgatagaaaggaacaagtttatccacaaatttatttatttatttatttatttatttatttatttgagacagggtctgactctacgacccaagctggagggcagtggtgcaatctcagctcactgcaaactctgcctcccaggctcaagccatcctcccgcctctgtctcctgagtagctggaactacaggcacacgccaccacacccagctagtttttgtattttttgtagagatgggttttcaccatgtttcccaagctggtctcaaactcctcaaaagagttaccaagcaggactctgcaaccaataatccttgtgtgaagaggatatttgctcttttccctgtttttctttcttggtacagatgtgtgacctctttttgaaaggtgatagtgactttggtgtattttatttggtggtaatggtcatagccccattaatcacatttcttcccatgagaaagaaaaaccactacatggtcatgctaaggatttcagtccctggggtgaggatggtcttgaatatctcctacattcataactcctccacacatctcagtaggtcactgagcacatcaatggacatgccagttattaaaatacttcacgaatactatgatcatttaccagtatgagttattctctggagcttctaatacttcaatagtactgcatggactcagttgagagttaattcaaaatctcagattatccaattctgtttctttccttccaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggtacaagtctccagggaaatggagctcaccctgacccaggctggttcaagcatattctgcctctcttaatctacatgacaatcgtgtggttgtacaatcatttgcttgtaagtctttttatcacaaaaaagtgataattatcaaactttacaaaccacagactagaaaaaacgaaactacatccatccacagtcccagcacaagacaaagataatcaattatgtccctgtgggcatttttctacgcctatatagatttttaaaaattagaatggtatcactttttatttggtttgaattgctgcttacttgatttaacaggaaactatccactgacctatattactataaatatacatatatatgtatatatataaatatatatatatgtatatattgcatatgccataaaccatttaaccatgatgttatttcaggtgtataggctttttattcctttctgttttttctatgctgtgccctttagctctctgaatttaacagaaactttaaaacatgcttccacattccatttgctttcaacgttacttgctatttcctctgtagtaattataagagtgcaggctgaggtcctgagaagtcctcatccctaatggtttaagccacttcactgaagacacaagacagcacaggtcctcctggtcctatctgtggctgcagtcctgtgccagctcccttatactctcagtagacatctcacacactcctccttggaggtgtcttgagcatgctcttctgggaattcagggacaaggtcaggccttaggcacagttcgcactctggatatagttggtgttttcccattactgtattattaagcaaaatttagaatgaaatttttagggtactggctggtgattcaggatgcttgggatctagactttcattagcccctacctgcaagtttgctgatgggaggaaccttgtcttgttggtcatggtgtccctagtgctagcatggagtctgcacataatacttgttcacagagtaagtcagagctgaccaagttctctgttttctggagtagaggacttctatgtttcctgcaagctcagcacttccacctcctgtggctgcactaatacgaaatcagagaccactcgctgtacttcactttgaatcactcagtcaccaaaaagatagtgcttgccatgtgtcaggaacttggctaggcagggagaaattcatatgatttatataaatccataaatccatatgatttacataaatccataaattcatgtgatatatacgtatatgtgtgtgtatatatatattagagaatgtttgacatatacacaagtacatgttaccgacaccagcctatagaatagttttcgtgcatctccatatatctatcactggttccaacagccatcaatccatgttagctgccccatccaaatgccaccatcaccctcctcctgactatcatgttattttgaagcaatagcctgtaaatatttcagaatgctctccaaaatataaagactcctgtaaaaacatatgacaacaatgccattattactttctttgaatcaacattttttccttaatataatcaaatatttagaaatcaaatttgaataaaacatgggtcaatcttcaaagaatttatagcttaatggaacagatcaaggaaagcagggatgacactacagtagggtagcatcatatgcccatgtaacttatgtgacttaaactatcctgtaagggtgtgggggagaaagagaggaagagatggagagaagaaaaaggaagagaaggaggaggagaaggaggcagaggagaaggtggacggggaaggtagagaggaggaggaggggaattagaaaaaaagagatgacaggagaaggaaagggaaaaataacaacttgaaatagcacaagacgttttctccttctcctttctcaatgagcatgtgaccaacacaagtgtgagttgaggcaggaatccacttttccatccatcagtcttatcatttatgtgccttttatagtgtgaacacatcaccaccctgaatataattttagtgtttagagataaatattatttgcaacaatattcatctcatctcaagaaacgctcctatagggtatggagaatttaaaggacctgtaggttatgatgattataacgaaataaccaaagcaggatttcaatgaccagcccacaaaagtatcctgtgtactactggttgggaggtggaggggggttgttcttaagtaagaacccctaacatgtaactctgtggtttttatgtttcattaactatttaatctaccaatatggaactaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacaggtcagtacactttctgtatgttttattaagaatttttttaactgaagggtatatattttttaaaagaatatgcatgtttatcttttaataattcattctatgggccaaagaacctacttggatccatctttgatcattaaggatgcttcagttctggacttcaaaacctgtagcattaagaacatcatgtaaagtccacacagattagcatgacatgattatgtgtagtctctttgaacctgagtaagtttaaattcagtttcaagtcaattggaaagaagtgttttgcacaatcatgaagtgcaatgattacctggctgtgacttaaatggtgttctccatcaccagaacctgcagaagctctctcatgacagtggttctcaaccactagctgtatattggaatcaccagggagcttcaaaaattcatgatgcctgtgacatctcagaaattctaaactaattaacccagagcgtgactaggttctgtcatgctgtcgggtgaacccctgattagttctcacgtgaagccaaggtggagaatgactaatttcaggcatttctggtggatatgaaggactaccatagagcagggctatccttactccttgaccttatgttccaggtgatacatttaaagaaagatttagaatcttttctctgaagaagttaaagaacagatgtcattgattcatattaagcaatagcctataagtcttatttccaggaccggtgtatttaatatgcaactctaccccttaagtacactttgtgcttgggagaggaggaggatggagatggttgccatcttatctatggcttcagggcagctgtgtagctttcctatgtgtgtattcaggcagggggctcagccctgagagaaagtgggcctctggcacacctgggacagggaagatattccctggcaagctctcaggcatctcaggctggcacttctttgtatccatggcaatttgctttcccctcactgaactgagatcagaatgttactctgttggtggctcccccaacagtgaaggggtgactcagtgacaatagtgctagaagtatgagtcaaaacactgtacaacttgagaaattccccgtttgcactacgcttggaagccaagaggagatgttaaaaagaaaagaataattctttctgaagacatttcccatcattgcacttgatgggttcaactgggaagggttactagactctggaagttgaaaactgcccacataattaaactgtacaacagctactcaggattaccttgcaagttttaacctataaaaatttaactttatatagcacttccaaaatagtttgccataatacctactaatctggatttaatttttaaaactcatccttttaacttaagatttaaataaaaaaaaaaaaacacgagtccacaagaatttgtctcaggcctggcacagagtcagtgctccataaatattttgttaaacgatggatggtgagtgcttttactatccagtatttacccagcttatagattaagtatgaagagttcaagatacatggtgttaagagtcgtttttatatgcttgcaaagcatttttgtcatattttttctactttgcttccatcttttcttctttcacttcatttattaattctccatatgcttgtttaactattgtagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgtactgcatgagtagttggtgattttgtacattcattgagctctcccagagtctgtgtagagtgttgtgcattatgtagtataaaggaggtgaccaggtaagtgacagataggtagactcagcttctctgcttctcataggactacctctacccacctctagttagcattatcaactcctcctgagctctcatcagagaataaatatttctcaacaatttgatccataacttttaagaaaaataagaattatcatgatgactctaatagtgacatttatatcacgttttatttgtaatattctataagttttatattaa
